United States Patent 11,446,398 (REGULATED BIOCIRCUIT SYSTEMS) - sequence listing, part 55

SEQ ID NO: 148787 - DNA, 604 bp, Homo sapiens
  Payload ID: 9425
  Gene Symbol: LST1
  Gene Name: leukocyte specific transcript 1
  Uniprot ID: O00453
  ENST ID: ENST00000303757
  CDS Start-End: 101-280
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148788 - DNA, 635 bp, Homo sapiens
  Payload ID: 9425
  Gene Symbol: LST1
  Gene Name: leukocyte specific transcript 1
  Uniprot ID: O00453
  ENST ID: ENST00000339530
  CDS Start-End: 210-410
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatca

SEQ ID NO: 148789 - DNA, 554 bp, Homo sapiens
  Payload ID: 9425
  Gene Symbol: LST1
  Gene Name: leukocyte specific transcript 1
  Uniprot ID: O00453
  ENST ID: ENST00000376086
  CDS Start-End: 101-322
atgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccc

SEQ ID NO: 148790 - DNA, 680 bp, Homo sapiens
  Payload ID: 9425
  Gene Symbol: LST1
  Gene Name: leukocyte specific transcript 1
  Uniprot ID: O00453
  ENST ID: ENST00000376089
  CDS Start-End: 247-447
ggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148791 - DNA, 689 bp, Homo sapiens
  Payload ID: 9425
  Gene Symbol: LST1
  Gene Name: leukocyte specific transcript 1
  ENST ID: ENST00000376090
  CDS Start-End: 279-365
ggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148792 - DNA, 285 bp, Homo sapiens
  Payload ID: 9425
  Gene Symbol: LST1
  Gene Name: leukocyte specific transcript 1
  Uniprot ID: O00453
  ENST ID: ENST00000376092
  CDS Start-End: 101-208
atgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgaga

SEQ ID NO: 148793 - DNA, 648 bp, Homo sapiens
  Payload ID: 9425
  Gene Symbol: LST1
  Gene Name: leukocyte specific transcript 1
  Uniprot ID: O00453
  ENST ID: ENST00000376093
  CDS Start-End: 101-415
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148794 - DNA, 565 bp, Homo sapiens
  Payload ID: 9425
  Gene Symbol: LST1
  Gene Name: leukocyte specific transcript 1
  Uniprot ID: O00453
  ENST ID: ENST00000376096
  CDS Start-End: 200-241
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148795 - DNA, 610 bp, Homo sapiens
  Payload ID: 9425
  Gene Symbol: LST1
  Gene Name: leukocyte specific transcript 1
  ENST ID: ENST00000376099
  CDS Start-End: 200-286
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148796 - DNA, 433 bp, Homo sapiens
  Payload ID: 9425
  Gene Symbol: LST1
  Gene Name: leukocyte specific transcript 1
  Uniprot ID: O00453
  ENST ID: ENST00000376110
  CDS Start-End: 197-352
ggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 148797 - DNA, 555 bp, Homo sapiens
  Payload ID: 9425
  Gene Symbol: LST1
  Gene Name: leukocyte specific transcript 1
  Uniprot ID: O00453
  ENST ID: ENST00000383480
  CDS Start-End: 101-322
atgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148798 - DNA, 532 bp, Homo sapiens
  Payload ID: 9425
  Gene Symbol: LST1
  Gene Name: leukocyte specific transcript 1
  Uniprot ID: O00453
  ENST ID: ENST00000383482
  CDS Start-End: 101-208
atgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148799 - DNA, 734 bp, Homo sapiens
  Payload ID: 9425
  Gene Symbol: LST1
  Gene Name: leukocyte specific transcript 1
  Uniprot ID: O00453
  ENST ID: ENST00000383484
  CDS Start-End: 210-410
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148800 - DNA, 648 bp, Homo sapiens; identical to SEQ ID NO: 148793
  Payload ID: 9425
  Gene Symbol: LST1
  Gene Name: leukocyte specific transcript 1
  Uniprot ID: O00453
  ENST ID: ENST00000383486
  CDS Start-End: 101-415

SEQ ID NO: 148801 - DNA, 459 bp, Homo sapiens
  Payload ID: 9425
  Gene Symbol: LST1
  Gene Name: leukocyte specific transcript 1
  ENST ID: ENST00000396101
  CDS Start-End: 1-135
atgttatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148802 - DNA, 382 bp, Homo sapiens
  Payload ID: 9425
  Gene Symbol: LST1
  Gene Name: leukocyte specific transcript 1
  ENST ID: ENST00000396112
  CDS Start-End: 184-382
gaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggaggctgccagtgcccagcagtgagggacctgacctcaggggcagagacaagagaggcaccaagg

SEQ ID NO: 148803 - DNA, 624 bp, Homo sapiens
  Payload ID: 9425
  Gene Symbol: LST1
  Gene Name: leukocyte specific transcript 1
  Uniprot ID: O00453
  ENST ID: ENST00000400250
  CDS Start-End: 121-300
gggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148804 - DNA, 689 bp, Homo sapiens; identical to SEQ ID NO: 148791
  Payload ID: 9425
  Gene Symbol: LST1
  Gene Name: leukocyte specific transcript 1
  ENST ID: ENST00000400251
  CDS Start-End: 279-365

SEQ ID NO: 148805 - DNA, 619 bp, Homo sapiens
  Payload ID: 9425
  Gene Symbol: LST1
  Gene Name: leukocyte specific transcript 1
  ENST ID: ENST00000400252
  CDS Start-End: 209-295
cctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148806 - DNA, 603 bp, Homo sapiens
  Payload ID: 9425
  Gene Symbol: LST1
  Gene Name: leukocyte specific transcript 1
  ENST ID: ENST00000400253
  CDS Start-End: 193-279
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148807 - DNA, 610 bp, Homo sapiens; identical to SEQ ID NO: 148795
  Payload ID: 9425
  Gene Symbol: LST1
  Gene Name: leukocyte specific transcript 1
  ENST ID: ENST00000400255
  CDS Start-End: 200-286

SEQ ID NO: 148808 - DNA, 565 bp, Homo sapiens; identical to SEQ ID NO: 148794
  Payload ID: 9425
  Gene Symbol: LST1
  Gene Name: leukocyte specific transcript 1
  Uniprot ID: O00453
  ENST ID: ENST00000400257
  CDS Start-End: 200-241

SEQ ID NO: 148809 - DNA, 665 bp, Homo sapiens
  Payload ID: 9425
  Gene Symbol: LST1
  Gene Name: leukocyte specific transcript 1
  ENST ID: ENST00000400261
  CDS Start-End: 184-432
gaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148810 - DNA, 571 bp, Homo sapiens
  Payload ID: 9425
  Gene Symbol: LST1
  Gene Name: leukocyte specific transcript 1
  Uniprot ID: O00453
  ENST ID: ENST00000400262
  CDS Start-End: 138-338
tgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148811 - DNA, 668 bp, Homo sapiens
  Payload ID: 9425
  Gene Symbol: LST1
  Gene Name: leukocyte specific transcript 1
  Uniprot ID: O00453
  ENST ID: ENST00000400263
  CDS Start-End: 235-435
ggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148812 - DNA, 712 bp, Homo sapiens
  Payload ID: 9425
  Gene Symbol: LST1
  Gene Name: leukocyte specific transcript 1
  Uniprot ID: O00453
  ENST ID: ENST00000400264
  CDS Start-End: 186-479
taaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148813 - DNA, 585 bp, Homo sapiens
  Payload ID: 9425
  Gene Symbol: LST1
  Gene Name: leukocyte specific transcript 1
  Uniprot ID: O00453
  ENST ID: ENST00000400265
  CDS Start-End: 197-352
ggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148814 - DNA, 712 bp, Homo sapiens; identical to SEQ ID NO: 148812
  Payload ID: 9425
  Gene Symbol: LST1
  Gene Name: leukocyte specific transcript 1
  Uniprot ID: O00453
  ENST ID: ENST00000429874
  CDS Start-End: 186-479

SEQ ID NO: 148815 - DNA, 603 bp, Homo sapiens; identical to SEQ ID NO: 148806
  Payload ID: 9425
  Gene Symbol: LST1
  Gene Name: leukocyte specific transcript 1
  ENST ID: ENST00000453818
  CDS Start-End: 193-279

SEQ ID NO: 148816 - DNA, 455 bp, Homo sapiens
  Payload ID: 9425
  Gene Symbol: LST1
  Gene Name: leukocyte specific transcript 1
  ENST ID: ENST00000433420
  CDS Start-End: 1-131
tatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148817 - DNA, 619 bp, Homo sapiens; identical to SEQ ID NO: 148805
  Payload ID: 9425
  Gene Symbol: LST1
  Gene Name: leukocyte specific transcript 1
  ENST ID: ENST00000448618
  CDS Start-End: 209-295

SEQ ID NO: 148818 - DNA, 610 bp, Homo sapiens; identical to SEQ ID NO: 148795
  Payload ID: 9425
  Gene Symbol: LST1
  Gene Name: leukocyte specific transcript 1
  ENST ID: ENST00000447512
  CDS Start-End: 200-286

SEQ ID NO: 148819 - DNA, 764 bp, Homo sapiens
  Payload ID: 9425
  Gene Symbol: LST1
  Gene Name: leukocyte specific transcript 1
  Uniprot ID: O00453
  ENST ID: ENST00000443741
  CDS Start-End: 238-531
gctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148820 - DNA, 259 bp, Homo sapiens
  Payload ID: 9425
  Gene Symbol: LST1
  Gene Name: leukocyte specific transcript 1
  ENST ID: ENST00000418551
  CDS Start-End: 122-259
cctatgttctggggattagcaatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagaacactgcctggccctggagccactg

SEQ ID NO: 148821 - DNA, 565 bp, Homo sapiens; identical to SEQ ID NO: 148794
  Payload ID: 9425
  Gene Symbol: LST1
  Gene Name: leukocyte specific transcript 1
  Uniprot ID: O00453
  ENST ID: ENST00000428898
  CDS Start-End: 200-241

SEQ ID NO: 148822 - DNA, 624 bp, Homo sapiens; identical to SEQ ID NO: 148803
  Payload ID: 9425
  Gene Symbol: LST1
  Gene Name: leukocyte specific transcript 1
  Uniprot ID: O00453
  ENST ID: ENST00000430997
  CDS Start-End: 121-300

SEQ ID NO: 148823 - DNA, 571 bp, Homo sapiens; identical to SEQ ID NO: 148810
  Payload ID: 9425
  Gene Symbol: LST1
  Gene Name: leukocyte specific transcript 1
  Uniprot ID: O00453
  ENST ID: ENST00000433004
  CDS Start-End: 138-338

SEQ ID NO: 148824 - DNA, 571 bp, Homo sapiens; identical to SEQ ID NO: 148810
  Payload ID: 9425
  Gene Symbol: LST1
  Gene Name: leukocyte specific transcript 1
  Uniprot ID: O00453
  ENST ID: ENST00000420797
  CDS Start-End: 138-338

SEQ ID NO: 148825 - DNA, 532 bp, Homo sapiens
  Payload ID: 9425
  Gene Symbol: LST1
  Gene Name: leukocyte specific transcript 1
  Uniprot ID: O00453
  ENST ID: ENST00000415490
  CDS Start-End: 101-208
atgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148826 - DNA, 555 bp, Homo sapiens; identical to SEQ ID NO: 148797
  Payload ID: 9425
  Gene Symbol: LST1
  Gene Name: leukocyte specific transcript 1
  Uniprot ID: O00453
  ENST ID: ENST00000457549
  CDS Start-End: 101-322

SEQ ID NO: 148827 - DNA, 585 bp, Homo sapiens
  Payload ID: 9425
  Gene Symbol: LST1
  Gene Name: leukocyte specific transcript 1
  Uniprot ID: O00453
  ENST ID: ENST00000438349
  CDS Start-End: 197-352
ggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148828 - DNA, 571 bp, Homo sapiens; identical to SEQ ID NO: 148810
  Payload ID: 9425
  Gene Symbol: LST1
  Gene Name: leukocyte specific transcript 1
  Uniprot ID: O00453
  ENST ID: ENST00000449236
  CDS Start-End: 138-338

SEQ ID NO: 148829 - DNA, 764 bp, Homo sapiens; identical to SEQ ID NO: 148819
  Payload ID: 9425
  Gene Symbol: LST1
  Gene Name: leukocyte specific transcript 1
  Uniprot ID: O00453
  ENST ID: ENST00000438075
  CDS Start-End: 238-531

SEQ ID NO: 148830 - DNA, 455 bp, Homo sapiens
  Payload ID: 9425
  Gene Symbol: LST1
  Gene Name: leukocyte specific transcript 1
  ENST ID: ENST00000418796
  CDS Start-End: 1-131
tatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148831 - DNA, 571 bp, Homo sapiens; identical to SEQ ID NO: 148810
  Payload ID: 9425
  Gene Symbol: LST1
  Gene Name: leukocyte specific transcript 1
  Uniprot ID: O00453
  ENST ID: ENST00000428405
  CDS Start-End: 138-338

SEQ ID NO: 148832 - DNA, 712 bp, Homo sapiens; identical to SEQ ID NO: 148812
  Payload ID: 9425
  Gene Symbol: LST1
  Gene Name: leukocyte specific transcript 1
  Uniprot ID: O00453
  ENST ID: ENST00000430632
  CDS Start-End: 186-479

SEQ ID NO: 148833 - DNA, 455 bp, Homo sapiens
  Payload ID: 9425
  Gene Symbol: LST1
  Gene Name: leukocyte specific transcript 1
  ENST ID: ENST00000415262
  CDS Start-End: 1-131
tatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148834 - DNA, 259 bp, Homo sapiens; identical to SEQ ID NO: 148820
  Payload ID: 9425
  Gene Symbol: LST1
  Gene Name: leukocyte specific transcript 1
  ENST ID: ENST00000419469
  CDS Start-End: 122-259

SEQ ID NO: 148835 - DNA, 734 bp, Homo sapiens; identical to SEQ ID NO: 148799
  Payload ID: 9425
  Gene Symbol: LST1
  Gene Name: leukocyte specific transcript 1
  Uniprot ID: O00453
  ENST ID: ENST00000438381
  CDS Start-End: 210-410

SEQ ID NO: 148836 - DNA, 734 bp, Homo sapiens
  Payload ID: 9425
  Gene Symbol: LST1
  Gene Name: leukocyte specific transcript 1
  Uniprot ID: O00453
  ENST ID: ENST00000420785
  CDS Start-End: 210-410
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148837 - DNA, 689 bp, Homo sapiens; identical to SEQ ID NO: 148791
  Payload ID: 9425
  Gene Symbol: LST1
  Gene Name: leukocyte specific transcript 1
  ENST ID: ENST00000421478
  CDS Start-End: 279-365

SEQ ID NO: 148838 - DNA, 259 bp, Homo sapiens; identical to SEQ ID NO: 148820
  Payload ID: 9425
  Gene Symbol: LST1
  Gene Name: leukocyte specific transcript 1
  ENST ID: ENST00000412931
  CDS Start-End: 122-259

SEQ ID NO: 148839 - DNA, 712 bp, Homo sapiens
  Payload ID: 9425
  Gene Symbol: LST1
  Gene Name: leukocyte specific transcript 1
  Uniprot ID: O00453
  ENST ID: ENST00000417428
  CDS Start-End: 186-479
taaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148840 - DNA, 555 bp, Homo sapiens
  Payload ID: 9425
  Gene Symbol: LST1
  Gene Name: leukocyte specific transcript 1
  Uniprot ID: O00453
  ENST ID: ENST00000440242
  CDS Start-End: 101-322
atgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148841 - DNA, 532 bp, Homo sapiens
  Payload ID: 9425
  Gene Symbol: LST1
  Gene Name: leukocyte specific transcript 1
  Uniprot ID: O00453
  ENST ID: ENST00000432164
  CDS Start-End: 101-208
atgaggaacttgaggcaagtcaccagcccctgatcatttcgcctaaaagagcaaggactagagttcctgacctccaggccagtccctgatccctgacctaatgttatcgcggaatgatgcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148842 - DNA, 585 bp, Homo sapiens; identical to SEQ ID NO: 148813
  Payload ID: 9425
  Gene Symbol: LST1
  Gene Name: leukocyte specific transcript 1
  Uniprot ID: O00453
  ENST ID: ENST00000437436
  CDS Start-End: 197-352

SEQ ID NO: 148843 - DNA, 712 bp, Homo sapiens; identical to SEQ ID NO: 148812
  Payload ID: 9425
  Gene Symbol: LST1
  Gene Name: leukocyte specific transcript 1
  Uniprot ID: O00453
  ENST ID: ENST00000411490
  CDS Start-End: 186-479

SEQ ID NO: 148844 - DNA, 259 bp, Homo sapiens; identical to SEQ ID NO: 148820
  Payload ID: 9425
  Gene Symbol: LST1
  Gene Name: leukocyte specific transcript 1
  ENST ID: ENST00000441641
  CDS Start-End: 122-259

SEQ ID NO: 148845 - DNA, 254 bp, Homo sapiens
  Payload ID: 9425
  Gene Symbol: LST1
  Gene Name: leukocyte specific transcript 1
  ENST ID: ENST00000429792
  CDS Start-End: 146-254
cacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaa

SEQ ID NO: 148846 - DNA, 555 bp, Homo sapiens
  Payload ID: 9425
  Gene Symbol: LST1
  Gene Name: leukocyte specific transcript 1
  Uniprot ID: O00453
  ENST ID: ENST00000454168
  CDS Start-End: 101-322
atgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148847 - DNA, 648 bp, Homo sapiens
  Payload ID: 9425
  Gene Symbol: LST1
  Gene Name: leukocyte specific transcript 1
  Uniprot ID: O00453
  ENST ID: ENST00000437812
  CDS Start-End: 101-415
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148848 - DNA, 712 bp, Homo sapiens; identical to SEQ ID NO: 148812
  Payload ID: 9425
  Gene Symbol: LST1
  Gene Name: leukocyte specific transcript 1
  Uniprot ID: O00453
  ENST ID: ENST00000455003
  CDS Start-End: 186-479

SEQ ID NO: 148849 - DNA, 668 bp, Homo sapiens
  Payload ID: 9425
  Gene Symbol: LST1
  Gene Name: leukocyte specific transcript 1
  Uniprot ID: O00453
  ENST ID: ENST00000440253
  CDS Start-End: 235-435
ggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148850 - DNA, 764 bp, Homo sapiens
  Payload ID: 9425
  Gene Symbol: LST1
  Gene Name: leukocyte specific transcript 1
  Uniprot ID: O00453
  ENST ID: ENST00000455901
  CDS Start-End: 238-531
gctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148851 - DNA, 585 bp, Homo sapiens; identical to SEQ ID NO: 148813
  Payload ID: 9425
  Gene Symbol: LST1
  Gene Name: leukocyte specific transcript 1
  Uniprot ID: O00453
  ENST ID: ENST00000422035
  CDS Start-End: 197-352

SEQ ID NO: 148852 - DNA, 764 bp, Homo sapiens; identical to SEQ ID NO: 148819
  Payload ID: 9425
  Gene Symbol: LST1
  Gene Name: leukocyte specific transcript 1
  Uniprot ID: O00453
  ENST ID: ENST00000443340
  CDS Start-End: 238-531

SEQ ID NO: 148853 - DNA, 668 bp, Homo sapiens; identical to SEQ ID NO: 148811
  Payload ID: 9425
  Gene Symbol: LST1
  Gene Name: leukocyte specific transcript 1
  Uniprot ID: O00453
  ENST ID: ENST00000436185
  CDS Start-End: 235-435

SEQ ID NO: 148854 - DNA, 565 bp, Homo sapiens; identical to SEQ ID NO: 148794
  Payload ID: 9425
  Gene Symbol: LST1
  Gene Name: leukocyte specific transcript 1
  Uniprot ID: O00453
  ENST ID: ENST00000447141
  CDS Start-End: 200-241

SEQ ID NO: 148855 - DNA, 668 bp, Homo sapiens
  Payload ID: 9425
  Gene Symbol: LST1
  Gene Name: leukocyte specific transcript 1
  Uniprot ID: O00453
  ENST ID: ENST00000455052
  CDS Start-End: 235-435
ggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148856 - DNA, 455 bp, Homo sapiens; identical to SEQ ID NO: 148830
  Payload ID: 9425
  Gene Symbol: LST1
  Gene Name: leukocyte specific transcript 1
  ENST ID: ENST00000412125
  CDS Start-End: 1-131

SEQ ID NO: 148857 - DNA, 603 bp, Homo sapiens; identical to SEQ ID NO: 148806
  Payload ID: 9425
  Gene Symbol: LST1
  Gene Name: leukocyte specific transcript 1
  ENST ID: ENST00000454186
  CDS Start-End: 193-279

SEQ ID NO: 148858 - DNA, 603 bp, Homo sapiens; identical to SEQ ID NO: 148806
  Payload ID: 9425
  Gene Symbol: LST1
  Gene Name: leukocyte specific transcript 1
  ENST ID: ENST00000435428
  CDS Start-End: 193-279

SEQ ID NO: 148859 - DNA, 648 bp, Homo sapiens
  Payload ID: 9425
  Gene Symbol: LST1
  Gene Name: leukocyte specific transcript 1
  Uniprot ID: O00453
  ENST ID: ENST00000436037
  CDS Start-End: 101-415
atgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148860 - DNA, 668 bp, Homo sapiens; identical to SEQ ID NO: 148811
  Payload ID: 9425
  Gene Symbol: LST1
  Gene Name: leukocyte specific transcript 1
  Uniprot ID: O00453
  ENST ID: ENST00000420157
  CDS Start-End: 235-435

SEQ ID NO: 148861 - DNA, 726 bp, Homo sapiens
  Payload ID: 9425
  Gene Symbol: LST1
  Gene Name: leukocyte specific transcript 1
  Uniprot ID: O00453
  ENST ID: ENST00000455426
  CDS Start-End: 293-493
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 148862 - DNA, 734 bp, Homo sapiens; identical to SEQ ID NO: 148799
  Payload ID: 9425
  Gene Symbol: LST1
  Gene Name: leukocyte specific transcript 1
  Uniprot ID: O00453
  ENST ID: ENST00000430680
  CDS Start-End: 210-410

SEQ ID NO: 148863 - DNA, 665 bp, Homo sapiens; identical to SEQ ID NO: 148809
  Payload ID: 9425
  Gene Symbol: LST1
  Gene Name: leukocyte specific transcript 1
  ENST ID: ENST00000426202
  CDS Start-End: 184-432

SEQ ID NO: 148864 - DNA, 624 bp, Homo sapiens
  Payload ID: 9425
  Gene Symbol: LST1
  Gene Name: leukocyte specific transcript 1
  Uniprot ID: O00453
  ENST ID: ENST00000429910
  CDS Start-End: 121-300
gggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148865 - DNA, 619 bp, Homo sapiens
  Payload ID: 9425
  Gene Symbol: LST1
  Gene Name: leukocyte specific transcript 1
  ENST ID: ENST00000413900
  CDS Start-End: 209-295
cctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148866 - DNA, 455 bp, Homo sapiens; identical to SEQ ID NO: 148830
  Payload ID: 9425
  Gene Symbol: LST1
  Gene Name: leukocyte specific transcript 1
  ENST ID: ENST00000455553
  CDS Start-End: 1-131

SEQ ID NO: 148867 - DNA, 648 bp, Homo sapiens; identical to SEQ ID NO: 148793
  Payload ID: 9425
  Gene Symbol: LST1
  Gene Name: leukocyte specific transcript 1
  Uniprot ID: O00453
  ENST ID: ENST00000412041
  CDS Start-End: 101-415

SEQ ID NO: 148868 - DNA, 532 bp, Homo sapiens; identical to SEQ ID NO: 148798
  Payload ID: 9425
  Gene Symbol: LST1
  Gene Name: leukocyte specific transcript 1
  Uniprot ID: O00453
  ENST ID: ENST00000427186
  CDS Start-End: 101-208

SEQ ID NO: 148869 - DNA, 734 bp, Homo sapiens; identical to SEQ ID NO: 148799
  Payload ID: 9425
  Gene Symbol: LST1
  Gene Name: leukocyte specific transcript 1
  Uniprot ID: O00453
  ENST ID: ENST00000442052
  CDS Start-End: 210-410

SEQ ID NO: 148870 - DNA, 254 bp, Homo sapiens; identical to SEQ ID NO: 148845
  Payload ID: 9425
  Gene Symbol: LST1
  Gene Name: leukocyte specific transcript 1
  ENST ID: ENST00000433492
  CDS Start-End: 146-254

SEQ ID NO: 148871 - DNA, 455 bp, Homo sapiens; identical to SEQ ID NO: 148830
  Payload ID: 9425
  Gene Symbol: LST1
  Gene Name: leukocyte specific transcript 1
  ENST ID: ENST00000420142
  CDS Start-End: 1-131

SEQ ID NO: 148872 - DNA, 585 bp, Homo sapiens
  Payload ID: 9425
  Gene Symbol: LST1
  Gene Name: leukocyte specific transcript 1
  Uniprot ID: O00453
  ENST ID: ENST00000423871
  CDS Start-End: 197-352
ggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148873 - DNA, 689 bp, Homo sapiens; identical to SEQ ID NO: 148791
  Payload ID: 9425
  Gene Symbol: LST1
  Gene Name: leukocyte specific transcript 1
  ENST ID: ENST00000414519
  CDS Start-End: 279-365

SEQ ID NO: 148874 - DNA, 259 bp, Homo sapiens; identical to SEQ ID NO: 148820
  Payload ID: 9425
  Gene Symbol: LST1
  Gene Name: leukocyte specific transcript 1
  ENST ID: ENST00000425495
  CDS Start-End: 122-259

SEQ ID NO: 148875 - DNA, 619 bp, Homo sapiens; identical to SEQ ID NO: 148805
  Payload ID: 9425
  Gene Symbol: LST1
  Gene Name: leukocyte specific transcript 1
  ENST ID: ENST00000452762
  CDS Start-End: 209-295

SEQ ID NO: 148876 - DNA, 603 bp, Homo sapiens; identical to SEQ ID NO: 148806
  Payload ID: 9425
  Gene Symbol: LST1
  Gene Name: leukocyte specific transcript 1
  ENST ID: ENST00000433188
  CDS Start-End: 193-279

SEQ ID NO: 148877 - DNA, 532 bp, Homo sapiens; identical to SEQ ID NO: 148798
  Payload ID: 9425
  Gene Symbol: LST1
  Gene Name: leukocyte specific transcript 1
  Uniprot ID: O00453
  ENST ID: ENST00000440328
  CDS Start-End: 101-208

SEQ ID NO: 148878 - DNA, 555 bp, Homo sapiens; identical to SEQ ID NO: 148797
  Payload ID: 9425
  Gene Symbol: LST1
  Gene Name: leukocyte specific transcript 1
  Uniprot ID: O00453
  ENST ID: ENST00000451922
  CDS Start-End: 101-322

SEQ ID NO: 148879 - DNA, 619 bp, Homo sapiens; identical to SEQ ID NO: 148805
  Payload ID: 9425
  Gene Symbol: LST1
  Gene Name: leukocyte specific transcript 1
  ENST ID: ENST00000443931
  CDS Start-End: 209-295

SEQ ID NO: 148880 - DNA, 565 bp, Homo sapiens
  Payload ID: 9425
  Gene Symbol: LST1
  Gene Name: leukocyte specific transcript 1
  Uniprot ID: O00453
  ENST ID: ENST00000455493
  CDS Start-End: 200-241
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148881 - DNA, 565 bp, Homo sapiens; identical to SEQ ID NO: 148794
  Payload ID: 9425
  Gene Symbol: LST1
  Gene Name: leukocyte specific transcript 1
  Uniprot ID: O00453
  ENST ID: ENST00000415781
  CDS Start-End: 200-241

SEQ ID NO: 148882 - DNA, 254 bp, Homo sapiens; identical to SEQ ID NO: 148845
  Payload ID: 9425
  Gene Symbol: LST1
  Gene Name: leukocyte specific transcript 1
  ENST ID: ENST00000450047
  CDS Start-End: 146-254

SEQ ID NO: 148883 - DNA, 254 bp, Homo sapiens; identical to SEQ ID NO: 148845
  Payload ID: 9425
  Gene Symbol: LST1
  Gene Name: leukocyte specific transcript 1
  ENST ID: ENST00000433520
  CDS Start-End: 146-254

SEQ ID NO: 148884 - DNA, 619 bp, Homo sapiens
  Payload ID: 9425
  Gene Symbol: LST1
  Gene Name: leukocyte specific transcript 1
  ENST ID: ENST00000430818
  CDS Start-End: 209-295
cctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148885 - DNA, 610 bp, Homo sapiens
  Payload ID: 9425
  Gene Symbol: LST1
  Gene Name: leukocyte specific transcript 1
  ENST ID: ENST00000453586
  CDS Start-End: 200-286
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148886 - DNA, 571 bp, Homo sapiens
  Payload ID: 9425
  Gene Symbol: LST1
  Gene Name: leukocyte specific transcript 1
  Uniprot ID: O00453
  ENST ID: ENST00000414266
  CDS Start-End: 138-338
tgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148887 - DNA, 585 bp, Homo sapiens; identical to SEQ ID NO: 148813
  Payload ID: 9425
  Gene Symbol: LST1
  Gene Name: leukocyte specific transcript 1
  Uniprot ID: O00453
  ENST ID: ENST00000446239
  CDS Start-End: 197-352

SEQ ID NO: 148888 - DNA, 603 bp, Homo sapiens
  Payload ID: 9425
  Gene Symbol: LST1
  Gene Name: leukocyte specific transcript 1
  ENST ID: ENST00000419521
  CDS Start-End: 193-279
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148889 - DNA, 648 bp, Homo sapiens; identical to SEQ ID NO: 148793
  Payload ID: 9425
  Gene Symbol: LST1
  Gene Name: leukocyte specific transcript 1
  Uniprot ID: O00453
  ENST ID: ENST00000438335
  CDS Start-End: 101-415

SEQ ID NO: 148890 - DNA, 665 bp, Homo sapiens; identical to SEQ ID NO: 148809
  Payload ID: 9425
  Gene Symbol: LST1
  Gene Name: leukocyte specific transcript 1
  ENST ID: ENST00000421781
  CDS Start-End: 184-432

SEQ ID NO: 148891 - DNA, 712 bp, Homo sapiens
  Payload ID: 9425
  Gene Symbol: LST1
  Gene Name: leukocyte specific transcript 1
  Uniprot ID: O00453
  ENST ID: ENST00000426938
  CDS Start-End: 186-479
taaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148892 - DNA, 555 bp, Homo sapiens; identical to SEQ ID NO: 148797
  Payload ID: 9425
  Gene Symbol: LST1
  Gene Name: leukocyte specific transcript 1
  Uniprot ID: O00453
  ENST ID: ENST00000450291
  CDS Start-End: 101-322

SEQ ID NO: 148893 - DNA, 610 bp, Homo sapiens
  Payload ID: 9425
  Gene Symbol: LST1
  Gene Name: leukocyte specific transcript 1
  ENST ID: ENST00000443051
  CDS Start-End: 200-286
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148894 - DNA, 610 bp, Homo sapiens; identical to SEQ ID NO: 148795
  Payload ID: 9425
  Gene Symbol: LST1
  Gene Name: leukocyte specific transcript 1
  ENST ID: ENST00000449388
  CDS Start-End: 200-286

SEQ ID NO: 148895 - DNA, 259 bp, Homo sapiens; identical to SEQ ID NO: 148820
  Payload ID: 9425
  Gene Symbol: LST1
  Gene Name: leukocyte specific transcript 1
  ENST ID: ENST00000441278
  CDS Start-End: 122-259

SEQ ID NO: 148896 - DNA, 726 bp, Homo sapiens; identical to SEQ ID NO: 148861
  Payload ID: 9425
  Gene Symbol: LST1
  Gene Name: leukocyte specific transcript 1
  Uniprot ID: O00453
  ENST ID: ENST00000418507
  CDS Start-End: 293-493

SEQ ID NO: 148897 - DNA, 565 bp, Homo sapiens
  Payload ID: 9425
  Gene Symbol: LST1
  Gene Name: leukocyte specific transcript 1
  Uniprot ID: O00453
  ENST ID: ENST00000458456
  CDS Start-End: 200-241
agaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148898 - DNA, 726 bp, Homo sapiens
  Payload ID: 9425
  Gene Symbol: LST1
  Gene Name: leukocyte specific transcript 1
  Uniprot ID: O00453
  ENST ID: ENST00000423107
  CDS Start-End: 293-493
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148899 - DNA, 648 bp, Homo sapiens; identical to SEQ ID NO: 148793
  Payload ID: 9425
  Gene Symbol: LST1
  Gene Name: leukocyte specific transcript 1
  Uniprot ID: O00453
  ENST ID: ENST00000448236
  CDS Start-End: 101-415

SEQ ID NO: 148900 - DNA, 734 bp, Homo sapiens
  Payload ID: 9425
  Gene Symbol: LST1
  Gene Name: leukocyte specific transcript 1
  Uniprot ID: O00453
  ENST ID: ENST00000451641
  CDS Start-End: 210-410
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148901 - DNA, 259 bp, Homo sapiens; identical to SEQ ID NO: 148820
  Payload ID: 9425
  Gene Symbol: LST1
  Gene Name: leukocyte specific transcript 1
  ENST ID: ENST00000442915
  CDS Start-End: 122-259

SEQ ID NO: 148902 - DNA, 254 bp, Homo sapiens; identical to SEQ ID NO: 148845
  Payload ID: 9425
  Gene Symbol: LST1
  Gene Name: leukocyte specific transcript 1
  ENST ID: ENST00000412283
  CDS Start-End: 146-254

SEQ ID NO: 148903 - DNA, 532 bp, Homo sapiens; identical to SEQ ID NO: 148798
  Payload ID: 9425
  Gene Symbol: LST1
  Gene Name: leukocyte specific transcript 1
  Uniprot ID: O00453
  ENST ID: ENST00000433305
  CDS Start-End: 101-208

SEQ ID NO: 148904 - DNA, 254 bp, Homo sapiens; identical to SEQ ID NO: 148845
  Payload ID: 9425
  Gene Symbol: LST1
  Gene Name: leukocyte specific transcript 1
  ENST ID: ENST00000439436
  CDS Start-End: 146-254

SEQ ID NO: 148905 - DNA, 665 bp, Homo sapiens
  Payload ID: 9425
  Gene Symbol: LST1
  Gene Name: leukocyte specific transcript 1
  ENST ID: ENST00000448749
  CDS Start-End: 184-432
gaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148906 - DNA, 665 bp, Homo sapiens; identical to SEQ ID NO: 148809
  Payload ID: 9425
  Gene Symbol: LST1
  Gene Name: leukocyte specific transcript 1
  ENST ID: ENST00000448381
  CDS Start-End: 184-432

SEQ ID NO: 148907 - DNA, 665 bp, Homo sapiens; identical to SEQ ID NO: 148809
  Payload ID: 9425
  Gene Symbol: LST1
  Gene Name: leukocyte specific transcript 1
  ENST ID: ENST00000425260
  CDS Start-End: 184-432

SEQ ID NO: 148908 - DNA, 565 bp, Homo sapiens; identical to SEQ ID NO: 148794
  Payload ID: 9425
  Gene Symbol: LST1
  Gene Name: leukocyte specific transcript 1
  Uniprot ID: O00453
  ENST ID: ENST00000413426
  CDS Start-End: 200-241

SEQ ID NO: 148909 - DNA, 726 bp, Homo sapiens; identical to SEQ ID NO: 148861
  Payload ID: 9425
  Gene Symbol: LST1
  Gene Name: leukocyte specific transcript 1
  Uniprot ID: O00453
  ENST ID: ENST00000448441
  CDS Start-End: 293-493

SEQ ID NO: 148910 - DNA, 764 bp, Homo sapiens; identical to SEQ ID NO: 148819
  Payload ID: 9425
  Gene Symbol: LST1
  Gene Name: leukocyte specific transcript 1
  Uniprot ID: O00453
  ENST ID: ENST00000453995
  CDS Start-End: 238-531

SEQ ID NO: 148911 - DNA, 648 bp, Homo sapiens; identical to SEQ ID NO: 148793
  Payload ID: 9425
  Gene Symbol: LST1
  Gene Name: leukocyte specific transcript 1
  Uniprot ID: O00453
  ENST ID: ENST00000412623
  CDS Start-End: 101-415

SEQ ID NO: 148912 - DNA, 726 bp, Homo sapiens; identical to SEQ ID NO: 148861
  Payload ID: 9425
  Gene Symbol: LST1
  Gene Name: leukocyte specific transcript 1
  Uniprot ID: O00453
  ENST ID: ENST00000432009
  CDS Start-End: 293-493

SEQ ID NO: 148913 - DNA, 532 bp, Homo sapiens; identical to SEQ ID NO: 148798
  Payload ID: 9425
  Gene Symbol: LST1
  Gene Name: leukocyte specific transcript 1
  Uniprot ID: O00453
  ENST ID: ENST00000425760
  CDS Start-End: 101-208

SEQ ID NO: 148914 - DNA, 254 bp, Homo sapiens; identical to SEQ ID NO: 148845
  Payload ID: 9425
  Gene Symbol: LST1
  Gene Name: leukocyte specific transcript 1
  ENST ID: ENST00000444783
  CDS Start-End: 146-254

SEQ ID NO: 148915 - DNA, 668 bp, Homo sapiens; identical to SEQ ID NO: 148811
  Payload ID: 9425
  Gene Symbol: LST1
  Gene Name: leukocyte specific transcript 1
  Uniprot ID: O00453
  ENST ID: ENST00000447391
  CDS Start-End: 235-435

SEQ ID NO: 148916 - DNA, 254 bp, Homo sapiens; identical to SEQ ID NO: 148845
  Payload ID: 9425
  Gene Symbol: LST1
  Gene Name: leukocyte specific transcript 1
  ENST ID: ENST00000436969
  CDS Start-End: 146-254

SEQ ID NO: 148917 - DNA, 603 bp, Homo sapiens
  Payload ID: 9425
  Gene Symbol: LST1
  Gene Name: leukocyte specific transcript 1
  ENST ID: ENST00000455346
  CDS Start-End: 193-279
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148918 - DNA, 624 bp, Homo sapiens; identical to SEQ ID NO: 148803
  Payload ID: 9425
  Gene Symbol: LST1
  Gene Name: leukocyte specific transcript 1
  Uniprot ID: O00453
  ENST ID: ENST00000420333
  CDS Start-End: 121-300

SEQ ID NO: 148919 - DNA, 726 bp, Homo sapiens; identical to SEQ ID NO: 148861
  Payload ID: 9425
  Gene Symbol: LST1
  Gene Name: leukocyte specific transcript 1
  Uniprot ID: O00453
  ENST ID: ENST00000433676
  CDS Start-End: 293-493

SEQ ID NO: 148920 - DNA, 624 bp, Homo sapiens; identical to SEQ ID NO: 148803
  Payload ID: 9425
  Gene Symbol: LST1
  Gene Name: leukocyte specific transcript 1
  Uniprot ID: O00453
  ENST ID: ENST00000443655
  CDS Start-End: 121-300

SEQ ID NO: 148921 - DNA, 689 bp, Homo sapiens; identical to SEQ ID NO: 148791
  Payload ID: 9425
  Gene Symbol: LST1
  Gene Name: leukocyte specific transcript 1
  ENST ID: ENST00000451371
  CDS Start-End: 279-365

SEQ ID NO: 148922 - DNA, 764 bp, Homo sapiens; identical to SEQ ID NO: 148819
  Payload ID: 9425
  Gene Symbol: LST1
  Gene Name: leukocyte specific transcript 1
  Uniprot ID: O00453
  ENST ID: ENST00000437137
  CDS Start-End: 238-531

SEQ ID NO: 148923 - DNA, 624 bp, Homo sapiens; identical to SEQ ID NO: 148803
  Payload ID: 9425
  Gene Symbol: LST1
  Gene Name: leukocyte specific transcript 1
  Uniprot ID: O00453
  ENST ID: ENST00000422533
  CDS Start-End: 121-300

SEQ ID NO: 148924 - DNA, 610 bp, Homo sapiens; identical to SEQ ID NO: 148795
  Payload ID: 9425
  Gene Symbol: LST1
  Gene Name: leukocyte specific transcript 1
  ENST ID: ENST00000441216
  CDS Start-End: 200-286

SEQ ID NO: 148925 - DNA, 689 bp, Homo sapiens; identical to SEQ ID NO: 148791
  Payload ID: 9425
  Gene Symbol: LST1
  Gene Name: leukocyte specific transcript 1
  ENST ID: ENST00000427164
  CDS Start-End: 279-365

SEQ ID NO: 148926 - DNA, 571 bp, Homo sapiens
  Payload ID: 9425
  Gene Symbol: LST1
  Gene Name: leukocyte specific transcript 1
  Uniprot ID: O00453
  ENST ID: ENST00000428227
  CDS Start-End: 138-338
tgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148927 - DNA, 764 bp, Homo sapiens; identical to SEQ ID NO: 148819
  Payload ID: 9425
  Gene Symbol: LST1
  Gene Name: leukocyte specific transcript 1
  Uniprot ID: O00453
  ENST ID: ENST00000434314
  CDS Start-End: 238-531

SEQ ID NO: 148928 - DNA, 555 bp, Homo sapiens; identical to SEQ ID NO: 148797
  Payload ID: 9425
  Gene Symbol: LST1
  Gene Name: leukocyte specific transcript 1
  Uniprot ID: O00453
  ENST ID: ENST00000420676
  CDS Start-End: 101-322

SEQ ID NO: 148929 - DNA, 665 bp, Homo sapiens
  Payload ID: 9425
  Gene Symbol: LST1
  Gene Name: leukocyte specific transcript 1
  ENST ID: ENST00000449799
  CDS Start-End: 184-432
gaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148930 - DNA, 455 bp, Homo sapiens; identical to SEQ ID NO: 148830
  Payload ID: 9425
  Gene Symbol: LST1
  Gene Name: leukocyte specific transcript 1
  ENST ID: ENST00000448633
  CDS Start-End: 1-131

SEQ ID NO: 148931 - DNA, 689 bp, Homo sapiens
  Payload ID: 9425
  Gene Symbol: LST1
  Gene Name: leukocyte specific transcript 1
  ENST ID: ENST00000453830
  CDS Start-End: 279-365
ggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148932 - DNA, 619 bp, Homo sapiens; identical to SEQ ID NO: 148805
  Payload ID: 9425
  Gene Symbol: LST1
  Gene Name: leukocyte specific transcript 1
  ENST ID: ENST00000429639
  CDS Start-End: 209-295

SEQ ID NO: 148933 - DNA, 668 bp, Homo sapiens; identical to SEQ ID NO: 148811
  Payload ID: 9425
  Gene Symbol: LST1
  Gene Name: leukocyte specific transcript 1
  Uniprot ID: O00453
  ENST ID: ENST00000440323
  CDS Start-End: 235-435

SEQ ID NO: 148934 - DNA, 585 bp, Homo sapiens; identical to SEQ ID NO: 148813
  Payload ID: 9425
  Gene Symbol: LST1
  Gene Name: leukocyte specific transcript 1
  Uniprot ID: O00453
  ENST ID: ENST00000415419
  CDS Start-End: 197-352

SEQ ID NO: 148935 - DNA, 726 bp, Homo sapiens
  Payload ID: 9425
  Gene Symbol: LST1
  Gene Name: leukocyte specific transcript 1
  Uniprot ID: O00453
  ENST ID: ENST00000450425
  CDS Start-End: 293-493
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148936 - DNA, 689 bp, Homo sapiens
  Payload ID: 9425
  Gene Symbol: LST1
  Gene Name: leukocyte specific transcript 1
  ENST ID: ENST00000426298
  CDS Start-End: 279-365
ggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148937 - DNA, 726 bp, Homo sapiens; identical to SEQ ID NO: 148861
  Payload ID: 9425
  Gene Symbol: LST1
  Gene Name: leukocyte specific transcript 1
  Uniprot ID: O00453
  ENST ID: ENST00000455655
  CDS Start-End: 293-493

SEQ ID NO: 148938 - DNA, 624 bp, Homo sapiens
  Payload ID: 9425
  Gene Symbol: LST1
  Gene Name: leukocyte specific transcript 1
  Uniprot ID: O00453
  ENST ID: ENST00000449273
  CDS Start-End: 121-300
gggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaataaaaaaaacacatggctcacccttccaccca

SEQ ID NO: 148939 - DNA, 610 bp, Homo sapiens; identical to SEQ ID NO: 148795
  Payload ID: 9425
  Gene Symbol: LST1
  Gene Name: leukocyte specific transcript 1
  ENST ID: ENST00000414821
  CDS Start-End: 200-286

SEQ ID NO: 148940 - DNA, 764 bp, Homo sapiens
  Payload ID: 9425
  Gene Symbol: LST1
  Gene Name: leukocyte specific transcript 1
  Uniprot ID: O00453
  ENST ID: ENST00000427507
  CDS Start-End: 238-531
gctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaaatgatcatcatcaaaacttatgtggctttttgacctttgaatagggaattttttaaattttttaaaaattaaaattaaaaaaacacatggctcacccttccaccca

SEQ ID NO: 148941 - DNA, 734 bp, Homo sapiens; identical to SEQ ID NO: 148799
  Payload ID: 9425
  Gene Symbol: LST1
  Gene Name: leukocyte specific transcript 1
  Uniprot ID: O00453
  ENST ID: ENST00000452169
  CDS Start-End: 210-410

SEQ ID NO: 148942 - DNA, 278 bp, Homo sapiens
  Payload ID: 9425
  Gene Symbol: LST1
  Gene Name: leukocyte specific transcript 1
  ENST ID: ENST00000464044
  CDS Start-End: 1-106
gggcgggctcctgcttctggcagtggtccttctgtccgcctgcctgtgttggctgcatcgaagagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 148943 - DNA, 273 bp, Homo sapiens
  Payload ID: 9425
  Gene Symbol: LST1
  Gene Name: leukocyte specific transcript 1
  ENST ID: ENST00000490742
  CDS Start-End: 1-182
atgatatatgtatctacgggggcctggggctgggcgggctcctgcttctggcagtggtccttctgtccgcctgcctgtgttggctgcatcgaagagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctga

SEQ ID NO: 148944 - DNA, 1467 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000348231
  CDS Start-End: 62-874
gcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcaca

SEQ ID NO: 148945 - DNA, 1511 bp, Homo sapiens
  Payload ID: 9426
  Gene Symbol: LAIR1
  Gene Name: leukocyte-associated immunoglobulin-like receptor 1
  ENST ID: ENST00000313038
  CDS Start-End: 175-1017
ccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctag

SEQ ID NO: 148946 - DNA, 846 bp, Homo sapiens
  Payload ID: 9426
  Gene Symbol: LAIR1
  Gene Name: leukocyte-associated immunoglobulin-like receptor 1
  ENST ID: ENST00000391741
  CDS Start-End: 67-450
ctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcaaaagctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccataccc

SEQ ID NO: 148947 - DNA, 4901 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000391742
  CDS Start-End: 154-1017
agaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaagaaagctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacagatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccctccacagcgtgctctattattttcctcatttataaaaacagaaactatggaccgagacatgaagtaacctgtccaaggtcggccaagtctcagagacaggggcttcagacccacctgaggctcctgactccacattatgaaccccgggatgggctgcagctcggtctgctgggaggtttctgtgctggttcaaagagggtggtacctgactggcctacccaattttaatttgtactgagctttaattttctatttgtgctcaggtttaatttcctcctgggatctgcttcccagtgctgtactctgtatctttgctttcttgtgtgaacattgtgaccgattttccctgttcttcacgtgggacacattctccctgctctgtctgtctctgtccctgtctctctttctgtctttctctctcactgtgtgtctctctgtctctctctctctttttttttttttttgagatggagtttcgctcttgttgcccaggctggagtgcaatggcacaatcttggctcactgcaacctctgcctcccgggttcaagcgattctcctgcctcagcctcctgagcagctgggattacaggcatgcaccaccacacacggctaattttttgtatttttgttagagacggggggctctccatgttgctcaggctggtcttgaactcccgacctcaggtgatctgcccacctcagcctcccaaagtcctgggattacaggcatgagccactgcgtccagccgtctttgtctctttttctacatctctgtctttcttctctggttgtttttcaaccatcagctgggtgttttctcccataacgtcttgtttgtttgactatgaggttgacaggtgggtacatgaactctatagcagaaggtggacagtctgcacatagcagaggatgggtgaatttttctaccccttgcagagcacaggagagctgagcagatgccagtgtctgctccagtgtaaggaagtccaggaagttcaggtggtgaggtcacagtggaaagcaggacagatagagtttaggggaaattaagcaaaaataccacactgttatttcttgacatattagtggaaagaggaagggcccagagagaagacagaaaattagatgcaggggcttgttttttctcttgacttgccaacccgcccaacgcaggggccagaactcagggtggtgagatctgggaacattgctgtgcggagaagatgtccctcctgctgcacgggcccccaagcaccacctgggggaagagccatgtttaattcacctggcagtgcagtgtggccaggcagagagggagggcctaccctgtgcttatgatcccaccccagttcccctggggtgtgccctggcggtgaacaccaggaggctgcagtggggcccaacgtgaaagggaggagcagcctcaccggggccagatggggcagcagcagatattcacagatgtccctgtgagtaaccagggcagaggccaggggtctggccttccctttcttggagccctgggccagctgggcaaggcgttgagagaaagattacccggtgacctttatcaaagcagagtaaggagggctttattcagaaccatcactgtaggtaccaggaccccagcggtgggattttgtagtaggggaaagaaaatgggctcgacgttgaatacagcatgaacaagtgagaatgtttgttatacaaactatagggtggactttttttttcttttttttaacttttttttaccttttagtgtaaaactgaacatagaaaataaattcatgaagaagggatattttctgagggtgtccagggctgcccaacacctcgtctaccttctctgtcatagccccatttaaaacactctctctggatgaatacaccaaacctcacagtctttgctctcttgctaggaagaggagcaagagcgtgtttcactcttggctcctgcttacacacctgctgtccaatggaaactactacttaagacatttaaaaatagttgtggtgatagcatgttgtgttttggttggtgatgccagttagtctctgaaaactttctgtgatgagtgtaaaattctacaccttaatctcctttcttgtaggatctgggaagcagtatgcacttgattgcaccaaagattttacgttcatagaaaatttctggcatctgtgtgaagaaagtaaactatatcttccatttagacaaataaaatatctttttgataaaa

SEQ ID NO: 148948 - DNA, 2735 bp, Homo sapiens
  Payload ID: 9426
  Gene Symbol: LAIR1
  Gene Name: leukocyte-associated immunoglobulin-like receptor 1
  ENST ID: ENST00000391743
  CDS Start-End: 282-1091
tggtatagcagaagctttttcacatctatgacacccgctatgtcttggtaaaccctggaagggaaaggaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaagaaagctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacagatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccctc

SEQ ID NO: 148949 - DNA, 1645 bp, Homo sapiens
  Payload ID: 9426
  Gene Symbol: LAIR1
  Gene Name: leukocyte-associated immunoglobulin-like receptor 1
  ENST ID: ENST00000434277
  CDS Start-End: 192-1052
tctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaagaaagctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcaca

SEQ ID NO: 148950 - DNA, 494 bp, Homo sapiens
  Payload ID: 9426
  Gene Symbol: LAIR1
  Gene Name: leukocyte-associated immunoglobulin-like receptor 1
  ENST ID: ENST00000438193
  CDS Start-End: 215-494
gaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatc

SEQ ID NO: 148951 - DNA, 533 bp, Homo sapiens
  Payload ID: 9426
  Gene Symbol: LAIR1
  Gene Name: leukocyte-associated immunoglobulin-like receptor 1
  ENST ID: ENST00000420483
  CDS Start-End: 128-262
agttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggtggacgctgagatcctgctctgcttccctcctagaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcaaaagctctggaggcccggactccccggacacagagcccggctcctcagctggacccacgcagaggccgtcggacaacagtcacaatgagcatgcacctgctt

SEQ ID NO: 148952 - DNA, 650 bp, Homo sapiens
  Payload ID: 9426
  Gene Symbol: LAIR1
  Gene Name: leukocyte-associated immunoglobulin-like receptor 1
  ENST ID: ENST00000436513
  CDS Start-End: 128-262
agttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggtggacgctgagatcctgctctgcttccctcctagaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaagaaagctctggaggcccggactccccggacacagagcccggctcctcagctggacccacgcagaggccgtcggacaacagtcacaatgagcatgcacctgcttcccaaggcctgaaagctgagcat

SEQ ID NO: 148953 - DNA, 936 bp, Homo sapiens
  Payload ID: 9426
  Gene Symbol: LAIR1
  Gene Name: leukocyte-associated immunoglobulin-like receptor 1
  ENST ID: ENST00000418556
  CDS Start-End: 64-525
ctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaagaaagctctggaggcccggactccccggacacagagcccggctcctcagctggacccacgcagaggccgtcggacaacagtcacaatgagcgtgagtgatgggggccgtggagcatgaagctggtgtgtgcctcttggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattaatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagagg

SEQ ID NO: 148954 - DNA, 814 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000474878
  CDS Start-End: 4-813
gccatgtctccccaccccaccgccctcctgggcctagtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgac

SEQ ID NO: 148955 - DNA, 1823 bp, Homo sapiens
  Payload ID: 9426
  Gene Symbol: LAIR1
  Gene Name: leukocyte-associated immunoglobulin-like receptor 1
  ENST ID: ENST00000616413
  CDS Start-End: 216-1079
tttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggccgggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgta

SEQ ID NO: 148956 - DNA, 482 bp, Homo sapiens
  Payload ID: 9426
  Gene Symbol: LAIR1
  Gene Name: leukocyte-associated immunoglobulin-like receptor 1
  ENST ID: ENST00000614880
  CDS Start-End: 128-262
agttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggtggacgctgagatcctgctctgcttccctcctagaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagacccacgcagaggccgtcggacaacagtcacaatgagcatgcacctgctt

SEQ ID NO: 148957 - DNA, 814 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000620726
  CDS Start-End: 4-813
gccatgtctccccaccccaccgccctcctgggcctagtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgac

SEQ ID NO: 148958 - DNA, 885 bp, Homo sapiens
  Payload ID: 9426
  Gene Symbol: LAIR1
  Gene Name: leukocyte-associated immunoglobulin-like receptor 1
  ENST ID: ENST00000618524
  CDS Start-End: 64-474
ctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcgtgagtgatgggggccgtggagcatgaagctggtgtgtgcctcttggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattaatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagagg

SEQ ID NO: 148959 - DNA, 814 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000614946
  CDS Start-End: 4-813
gccatgtctccccaccccaccgccctcctgggcctagtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgac

SEQ ID NO: 148960 - DNA, 795 bp, Homo sapiens
  Payload ID: 9426
  Gene Symbol: LAIR1
  Gene Name: leukocyte-associated immunoglobulin-like receptor 1
  ENST ID: ENST00000612909
  CDS Start-End: 67-399
ctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccataccc

SEQ ID NO: 148961 - DNA, 814 bp, Homo sapiens; identical to SEQ ID NO: 148957
  Payload ID: 9426
  Gene Symbol: LAIR1
  Gene Name: leukocyte-associated immunoglobulin-like receptor 1
  Uniprot ID: Q6GTX8
  ENST ID: ENST00000614937
  CDS Start-End: 4-813

SEQ ID NO: 148962 - DNA, 1726 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000618434
  CDS Start-End: 119-982
ggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgta

SEQ ID NO: 148963 - DNA, 2735 bp, Homo sapiens
  Payload ID: 9426
  Gene Symbol: LAIR1
  Gene Name: leukocyte-associated immunoglobulin-like receptor 1
  ENST ID: ENST00000618291
  CDS Start-End: 282-1091
tggtatagcagaagctttttcacatctatgacacccgctatgtcttggtaaaccctggaagggaaaggaggacaaggttaaaatactgttccgaggatctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcaccacgaatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcgcggtggctcacgcctgtaatcccagcactttgggaggctgaggtgggcggatcacgaggtcaggagatcgagaccatcctggctaacacggtgaaaccccatctctactaaaaatacaaaaaaattagctgggcgtggtggcgggcacctgtagtcccagctactcgggaggctgaggcaggagaatggcgtgaacccgggaggcggagcttgcagtgagccgaggtggtgccactgcactccagcctgggcgacagagcgagactccgtcaaaaaaaaaaagaaaagaaaagaaagatttttaagaattcagcaaaaactcagccagctctttctatggggcagttgctaatttagttctaggcaaacgtggacacattaaattctcctacaaaccctc

SEQ ID NO: 148964 - DNA, 1522 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000620357
  CDS Start-End: 119-931
ggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctca

SEQ ID NO: 148965 - DNA, 1515 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000616612
  CDS Start-End: 61-924
cagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctca

SEQ ID NO: 148966 - DNA, 4903 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000619717
  CDS Start-End: 154-1017
agaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcaccacgaatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcgcggtggctcacgcctgtaatcccagcactttgggaggctgaggtgggcggatcacgaggtcaggagatcgagaccatcctggctaacacggtgaaaccccatctctactaaaaatacaaaaaaattagctgggcgtggtggcgggcacctgtagtcccagctactcgggaggctgaggcaggagaatggcgtgaacccgggaggcggagcttgcagtgagccgaggtggtgccactgcactccagcctgggcgacagagcgagactccgtcaaaaaaaaaaagaaaagaaaagaaagatttttaagaattcagcaaaaactcagccagctctttctatggggcagttgctaatttagttctaggcaaacgtggacacattaaattctcctacaaaccctccacagcgtgctctattattttcctcatttataaaaacagaaactatggaccgagacatgaagtaacctgtccaaggtcggccaagtctcagagacaggggcttcagacccacctgaggctcctgactccacattatgaaccccgggatgggctgcagctcggtctgctgggaggtttctgtgctggttcaaagagggtggtacctgactggcctacccaattttaatttgtactgagctttaattttctatttgtgctcaggtttaatttcctcctgggatctgcttcccagtgctgtactctgtatctttgctttcttgtgtgaacattgtgaccgattttccctgttcttcacgtgggacacattctccctgctctgtctgtctctgtccctgtctctctttctgtctttctctctcactgtgtgtctctctgtctctctctctcttttttttttctttgagatggagtttcgctcttgttgcccaggctggagtgcaatggcgcaatcttggctcactgcaacctctgcctcccgggttcaagcgattctcctgcctcagcctcctgagcagctgggattacaggcatgcaccaccacacacggctaattttttgtatttttgttagagacggggggctctccatgttgcttaggctggttttgaactcccgacctcaggtgatctgcccacctcagcctcccaaagtcctgggattacaggcgtgagccactgcgtccagccgtctttgtctctttttctacatctctgtctttcttctctggttgtttttcaaccatcagccgggtgttttcccccataacgtcttgtttgtttgactatgaggttgacaggtgggtacatgaactctatagcagaaggtggacagtctgcacatagcagaggatgggtgaatttttctaccccttgcagagcacaggagagctgagcagatgccagtgtctgctccagtgtaaggaagtccaggaagttcaggtggtgaggtcacagtggaaagcaggacagatagagtttaggggaaattaagcaaaaataccacactgttgtttcttgacatattagtggaaagaggaagggcccagagagaagacagaaaattagatgcaggggcttgttttttctcttgacttgccaacccgcccaacgcaggggccagaactcagggtggtgagatctgggaacattgctgtgcggagaagatgtccctcctgctgcacgggcccccaagcaccacctgggggaagagccatgtttaattcacctggcagtgcagtgtggccaggcagagagggagggcctaccctgtgcttatgatcccaccccagttcccctggggtgtgccctggcggtgaacaccaggaggctgcagtggggcccaacgtgaaagggaggagcagcctcaccggggccagatggggcagcagcagatattcacagatgtccctgtgagtaaccagggcagaggccaggggtctggccttccctttcttggagccctgggccagctgggcaaggcgttgagagaaagattacccggtgacctttatcaaagcagagtaaggagggctttattcagaaccatcactgtaggtaccaggaccccagcggtgggattttgtagtaggggaaagaaaatgggctcgacgttgaatacagcatgaacaagtgagaatgtttgttatacaaactatagggtggactttttttttcttttttttaactttttttttaccttttagtgtaaaactgaacatagaaaataaattcatgaagaagggatattttctgagggtgtccagggctgcccaacacctcttgtctaccttctctgtcatagccccatttaaaacactctctctggatgaatacaccaaacctcacagtctttgctctcttgctaggaagaggagcaagagcgtgtttcactcttggctcctgcttacacacctgccgtccaatggaaactactacttaagacatttaaaaatagttgtggtgatagcatgttgtgttttggttggtgatgccagttagtctctgaaaactttctgtgatgagtgtaaaattctacaccttaatctcctttcttgtaggatctgggaagcagtatgcacttgattgcaccaaagattttacgttcatagaaaatttctggcatctgtgtgaagaaagtaaactatatcttccatttaaacaaataaaatatctttttgataaaa

SEQ ID NO: 148967 - DNA, 2570 bp, Homo sapiens
  Payload ID: 9426
  Gene Symbol: LAIR1
  Gene Name: leukocyte-associated immunoglobulin-like receptor 1
  ENST ID: ENST00000621291
  CDS Start-End: 246-1055
gctatgtcttggtaaaccctggaagggaaaggaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcaccacgaatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcgcggtggctcacgcctgtaatcccagcactttgggaggctgaggtgggcggatcacgaggtcaggagatcgagaccatcctggctaacacggtgaaaccccatctctactaaaaatacaaaaaaattagctgggcgtggtggcgggcacctgtagtcccagctactcgggaggctgaggcaggagaatggcgtgaacccgggaggcggagcttgcagtgagccgaggtggtgccactgcactccagcctgggcgacagagcgagactccgtc

SEQ ID NO: 148968 - DNA, 1465 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000619817
  CDS Start-End: 62-874
gcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctca

SEQ ID NO: 148969 - DNA, 1465 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000622097
  CDS Start-End: 62-874
gcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctca

SEQ ID NO: 148970 - DNA, 1594 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000610549
  CDS Start-End: 192-1001
tctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcaca

SEQ ID NO: 148971 - DNA, 2606 bp, Homo sapiens
  Payload ID: 9426
  Gene Symbol: LAIR1
  Gene Name: leukocyte-associated immunoglobulin-like receptor 1
  ENST ID: ENST00000616724
  CDS Start-End: 282-1091
tggtatagcagaagctttttcacatctatgacacccgctatgtcttggtaaaccctggaagggaaaggaggacaaggttaaaatactgttccgaggatctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggccgggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcaccacgaatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcgcggtggctcacgcctgtaatcccagcactttgggaggctgaggtgggcggatcacgaggtcaggagatcgagaccatcctggctaacacggtgaaaccccatctctactaaaaatacaaaaaaattagctgggcgtggtggcgggcacctgtagtcccagctactcgggaggctgaggcaggagaatggcgtgaacccgggaggcggagcttgcagtgagccgaggtggtgccactgcactccagcctgggcgacagagcgagactccgtc

SEQ ID NO: 148972 - DNA, 2762 bp, Homo sapiens
  Payload ID: 9426
  Gene Symbol: LAIR1
  Gene Name: leukocyte-associated immunoglobulin-like receptor 1
  ENST ID: ENST00000611304
  CDS Start-End: 289-1119
tagcagaagctttttcacatctatgacacccgctatgtcttggtaaaccctggaagggaaaggaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcaccacgaatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcgcggtggctcacgcctgtaatcccagcactttgggaggctgaggtgggcggatcacgaggtcaggagatcgagaccatcctggctaacacggtgaaaccccatctctactaaaaatacaaaaaaattagctgggcgtggtggcgggcacctgtagtcccagctactcgggaggctgaggcaggagaatggcgtgaacccgggaggcggagcttgcagtgagccgaggtggtgccactgcactccagcctgggcgacagagcgagactccgtcaaaaaaaaaaagaaaagaaaagaaagatttttaagaattcagcaaaaactcagccagctctttctatggggcagttgctaatttagttctaggcaaacgtggacacattaaattctcctacaaaccct

SEQ ID NO: 148973 - DNA, 707 bp, Homo sapiens
  Payload ID: 9426
  Gene Symbol: LAIR1
  Gene Name: leukocyte-associated immunoglobulin-like receptor 1
  ENST ID: ENST00000617370
  CDS Start-End: 1-240
gagcagagtgactacctggagctgctggtgaaagaaacctctggaggcccggactccccggacacagagcccggctcctcagctgggactgtgccaggcactgaagcctccggatttgatgcaccaagaatgaggagaaatggcctcccgtcttgtgaacttcaatggggagaaatagttagaatgagcaatagaaatgcactgattcccatacatgcatatacagataaaaatatatgatttgcaatgtagaatttcagacctataatttaaattatattatatatgtttacatcataatatatatatattatatatatattatatatataaggaagataattatataataaaacatgttagtgtatcactacatatgactatagtgtatattatatattatatgaaagatatatttacaatatatagtataataaatttcaagtgttatagttaataaataaatataggtattaatgtaaatatattatctattatgtatacattatgtataactataatagaaaaaatattttatatttaatcataggtttatatcaaatataaattatacattatatattatagtgaatatatgtaacatatattataagttataaatcatatacaattaacattatatacattaaattatatgtatatgtcaagattacataattaaaaatatatttgttatatattataca

SEQ ID NO: 148974 - DNA, 1609 bp, Homo sapiens
  Payload ID: 9426
  Gene Symbol: LAIR1
  Gene Name: leukocyte-associated immunoglobulin-like receptor 1
  ENST ID: ENST00000617386
  CDS Start-End: 192-1052
tctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgcttta

SEQ ID NO: 148975 - DNA, 1467 bp, Homo sapiens
  Payload ID: 9426
  Gene Symbol: LAIR1
  Gene Name: leukocyte-associated immunoglobulin-like receptor 1
  Uniprot ID: Q6GTX8
  ENST ID: ENST00000620077
  CDS Start-End: 62-874
gcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcaca

SEQ ID NO: 148976 - DNA, 599 bp, Homo sapiens
  Payload ID: 9426
  Gene Symbol: LAIR1
  Gene Name: leukocyte-associated immunoglobulin-like receptor 1
  ENST ID: ENST00000617129
  CDS Start-End: 128-262
agttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggtggacgctgagatcctgctctgcttccctcctagaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcat

SEQ ID NO: 148977 - DNA, 2606 bp, Homo sapiens
  Payload ID: 9426
  Gene Symbol: LAIR1
  Gene Name: leukocyte-associated immunoglobulin-like receptor 1
  ENST ID: ENST00000621769
  CDS Start-End: 282-1091
tggtatagcagaagctttttcacatctatgacacccgctatgtcttggtaaaccctggaagggaaaggaggacaaggttaaaatactgttccgaggatctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacctacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtc

SEQ ID NO: 148978 - DNA, 705 bp, Homo sapiens
  Payload ID: 9426
  Gene Symbol: LAIR1
  Gene Name: leukocyte-associated immunoglobulin-like receptor 1
  ENST ID: ENST00000622064
  CDS Start-End: 1-240
gagcagagtgactacctggagctgctggtgaaagaaagctctggaggcccggactccccggacacagagcccggctcctcagctgggactgtgccaggcactgaagcctccggatttgatgcaccaagaatgaggagaaatggcctcccgtcttgtgaacttcaatggggagaaatagttagaatgagcaatagaaatgcactgattcccatacatgcatatacagataaaaatatatgatttgcaatgtagaatttcagacctataatttaaattatattatatatgtttacatcataatatatatatatattatatatatattatatatataaggaagataattatataataaaacatgttagtgtatcactacatatgactatagtgtatattatatattatatgaaagatatatttacaatatatagtataataaatttcaagtgttatagttaataaataaatataggtattaatgtaaatatattatctattatgtatacattatgtataactataatagaaaaaatattttatatttaatcataggtttatatcaaatataaattatacattatatattatagtgaatatatgtaacatatattataagttataaatcatatacaattaacattatatacattaaattatatgtatatgtcaagattacataattaaaaatatatttgttatatatta

SEQ ID NO: 148979 - DNA, 1609 bp, Homo sapiens
  Payload ID: 9426
  Gene Symbol: LAIR1
  Gene Name: leukocyte-associated immunoglobulin-like receptor 1
  ENST ID: ENST00000617029
  CDS Start-End: 192-1052
tctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgcttta

SEQ ID NO: 148980 - DNA, 1633 bp, Homo sapiens
  Payload ID: 9426
  Gene Symbol: LAIR1
  Gene Name: leukocyte-associated immunoglobulin-like receptor 1
  ENST ID: ENST00000613311
  CDS Start-End: 216-1076
tttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggccgggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacagacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgcttta

SEQ ID NO: 148981 - DNA, 699 bp, Homo sapiens
  Payload ID: 9427
  Gene Symbol: LAIR2
  Gene Name: leukocyte-associated immunoglobulin-like receptor 2
  Uniprot ID: Q6ISS4
  ENST ID: ENST00000301202
  CDS Start-End: 123-581
aacagaacagaaagctctccctcttgtgtgaggcagttgctgtggaagccccacgggcaggaggcccccggccagcacatcctgtctgcttgtgtctgctgcagagttctgggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagaaagctctggaggcccggactccccggacacagagcccggctcctcagctgggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaa

SEQ ID NO: 148982 - DNA, 538 bp, Homo sapiens
  Payload ID: 9427
  Gene Symbol: LAIR2
  Gene Name: leukocyte-associated immunoglobulin-like receptor 2
  Uniprot ID: Q6ISS4
  ENST ID: ENST00000351841
  CDS Start-End: 13-420
gggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaa

SEQ ID NO: 148983 - DNA, 631 bp, Homo sapiens
  Payload ID: 9427
  Gene Symbol: LAIR2
  Gene Name: leukocyte-associated immunoglobulin-like receptor 2
  ENST ID: ENST00000412608
  CDS Start-End: 364-631
cttcttaaggatttgagctgtgatgctggcacctggcagaccacatcctgtgcggttttcagttttgctctgttcctgaccctggtatagcagaagctttttcacatctatgacacccgctatgtcttggtaaaccctggaagggaaaggaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgggccagaagatggaaagagaaatggtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatg

SEQ ID NO: 148984 - DNA, 699 bp, Homo sapiens
  Payload ID: 9427
  Gene Symbol: LAIR2
  Gene Name: leukocyte-associated immunoglobulin-like receptor 2
  Uniprot ID: Q6ISS4
  ENST ID: ENST00000622556
  CDS Start-End: 123-581
aacagaacagaaagctctccctcttgtgtgaggcagttgctgtggaaaccccacgggcaggaggcccccggccagcacatcctgtctgcttgtgtctgctgcagagttctgggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagaaagctctggaggcccggactccccggacacagagcccggctcctcagctgggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaa

SEQ ID NO: 148985 - DNA, 663 bp, Homo sapiens
  Payload ID: 9427
  Gene Symbol: LAIR2
  Gene Name: leukocyte-associated immunoglobulin-like receptor 2
  ENST ID: ENST00000611580
  CDS Start-End: 364-663
cttcttaaggatttgagctgtgatgctggcacctggcagaccacatcctgtgcggttttcagttttgctctgttcctgaccctggtatagcagaagctttttcacatctatgacacccgctatgtcttggtaaaccctggaagggaaaggaggacaaggttaaaatactgttccgaggacctggtctctccacagcgcaggctggaggtggcagcccatggaaagccaagttcatccaccatcggagcccaggccaggctgccaaggctaatattcaggacaaagccaggcacaggtcgggaatcctatgaagatgatcatcgtcctgaggtcttccttccagggttgcatccgggccagaagatggaaagagaaatggtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccc

SEQ ID NO: 148986 - DNA, 543 bp, Homo sapiens
  Payload ID: 9427
  Gene Symbol: LAIR2
  Gene Name: leukocyte-associated immunoglobulin-like receptor 2
  Uniprot ID: Q6ISS4
  ENST ID: ENST00000620256
  CDS Start-End: 18-425
gttctgggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaa

SEQ ID NO: 148987 - DNA, 1259 bp, Homo sapiens
  Payload ID: 9427
  Gene Symbol: LAIR2
  Gene Name: leukocyte-associated immunoglobulin-like receptor 2
  Uniprot ID: Q6ISS4
  ENST ID: ENST00000612901
  CDS Start-End: 262-720
attctgtcttgtcccatagatttagaaagaggctgacacatcgggtaactagtttaaggtcatctgatcatgcgggtaagcgacatttttcagaaaccaaggccctccctctcatctcactagtgggaagggtggaaagaacagaacagaaagctctccctcttgtgtgaggcagttgctgtggaaaccccacgggcaggaggcccccggccagcacatcctgtctgcttgtgtctgctgcagagttctgggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagaaagctctggaggcccggactccccggacacagagcccggctcctcagctgggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaatggagaatttcagacctatcatttcaattatattaaatatgttcacgtaatgtattacatatataaggaacataattatataataaaaatatgttaacatatcaccacatatcactataattatattatatgaaagatttatttacaatatatagtacaataaatttcaggtgttattataattaataaacaggtacaaacataaatatatattatctattatttatagattataattataatagaaaaattttatatttaattatatgtttatatgtaatatacattatacattatatattatagtgaatatatgcaacatatattataagtataaatcatatacaattaacattatatacattaaattatgatgtatatgtcaagattacataatttaatatatatttgttatatatta

SEQ ID NO: 148988 - DNA, 543 bp, Homo sapiens
  Payload ID: 9427
  Gene Symbol: LAIR2
  Gene Name: leukocyte-associated immunoglobulin-like receptor 2
  ENST ID: ENST00000621509
  CDS Start-End: 18-543
gttctgggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagggactgtgccaggcactgaagcctccggatttgatgcaccaagaatgaggagaaatggcctcccgtcttgtgaacttcaatggggagaaataattagaatgagcaatagaaatgcacagatgcctatacatacatatacaaataaaaagatacgattcgcaa

SEQ ID NO: 148989 - DNA, 595 bp, Homo sapiens
  Payload ID: 9427
  Gene Symbol: LAIR2
  Gene Name: leukocyte-associated immunoglobulin-like receptor 2
  ENST ID: ENST00000622782
  CDS Start-End: 364-595
cttcttaaggatttgagctgtgatgctggcacctggcagaccacatcctgtgcggttttcagttttgctctgttcctgaccctggtatagcagaagctttttcacatctatgacacccgctatgtcttggtaaaccctggaagggaaaggaggacaaggttaaaatactgttccgaggacctggtctctccacagcgcaggctggaggtggcagcccatggaaagccaagttcatccaccatcggagcccaggccaggctgccaaggctaatattcaggacaaagccaggcacaggtcgggaatcctatgaagatgatcatcgtcctgaggtcttccttccagggttgcatccgggccagaagatggaaagagaaatgggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatg

SEQ ID NO: 148990 - DNA, 709 bp, Homo sapiens
  Payload ID: 9427
  Gene Symbol: LAIR2
  Gene Name: leukocyte-associated immunoglobulin-like receptor 2
  ENST ID: ENST00000621365
  CDS Start-End: 364-709
cttcttaaggatttgagctgtgatgctggcacctggcagaccacatcctgtgcggttttcagttttgctctgttcctgaccctggtatagcagaagctttttcacatctatgacacccgctatgtcttggtaaaccctggaagggaaaggaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgggccagaagatggaaagagaaatggtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaag

SEQ ID NO: 148991 - DNA, 595 bp, Homo sapiens
  Payload ID: 9427
  Gene Symbol: LAIR2
  Gene Name: leukocyte-associated immunoglobulin-like receptor 2
  ENST ID: ENST00000622161
  CDS Start-End: 364-595
cttcttaaggatttgagctgtgatgctggcacctggcagaccacatcctgtgcggttttcagttttgctctgttcctgaccctggtatagcagaagctttttcacatctatgacacccgctatgtcttggtaaaccctggaagggaaaggaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgggccagaagatggaaagagaaatgggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatg

SEQ ID NO: 148992 - DNA, 595 bp, Homo sapiens; identical to SEQ ID NO: 148991
  Payload ID: 9427
  Gene Symbol: LAIR2
  Gene Name: leukocyte-associated immunoglobulin-like receptor 2
  ENST ID: ENST00000613846
  CDS Start-End: 364-595

SEQ ID NO: 148993 - DNA, 631 bp, Homo sapiens; identical to SEQ ID NO: 148983
  Payload ID: 9427
  Gene Symbol: LAIR2
  Gene Name: leukocyte-associated immunoglobulin-like receptor 2
  ENST ID: ENST00000613910
  CDS Start-End: 364-631

SEQ ID NO: 148994 - DNA, 538 bp, Homo sapiens; identical to SEQ ID NO: 148982
  Payload ID: 9427
  Gene Symbol: LAIR2
  Gene Name: leukocyte-associated immunoglobulin-like receptor 2
  Uniprot ID: Q6ISS4
  ENST ID: ENST00000621280
  CDS Start-End: 13-420

SEQ ID NO: 148995 - DNA, 1259 bp, Homo sapiens
  Payload ID: 9427
  Gene Symbol: LAIR2
  Gene Name: leukocyte-associated immunoglobulin-like receptor 2
  ENST ID: ENST00000618103
  CDS Start-End: 262-888
attctgtcttgtcccatagatttagaaagaggctgacacatcgggtaactagtttaaggtcatctgatcatgcgggtaagcgacatttttcagaaaccaaggccctccctctcatctcactagtgggaagggtggaaagaacagaacagaaagctctccctcttgtgtgaggcagttgctgtggaaaccccacgggcaggaggcccccggccagcacatcctgtctgcttgtgtctgctgcagagttctgggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagaaagctctggaggcccggactccccggacacagagcccggctcctcagctgggactgtgccaggcactgaagcctccggatttgatgcaccaagaatgaggagaaatggcctcccgtcttgtgaacttcaatggggagaaataattagaatgagcaatagaaatgcacagatgcctatacatacatatacaaataaaaagatacgattcgcaatggagaatttcagacctatcatttcaattatattaaatatgttcacgtaatgtattacatatataaggaacataattatataataaaaatatgttaacatatcaccacatatcactataattatattatatgaaagatttatttacaatatatagtacaataaatttcaggtgttattataattaataaacaggtacaaacataaatatatattatctattatttatagattataattataatagaaaaattttatatttaattatatgtttatatgtaatatacattatacattatatattatagtgaatatatgcaacatatattataagtataaatcatatacaattaacattatatacattaaattatgatgtatatgtcaagattacataatttaatatatatttgttatatatta

SEQ ID NO: 148996 - DNA, 595 bp, Homo sapiens; identical to SEQ ID NO: 148991
  Payload ID: 9427
  Gene Symbol: LAIR2
  Gene Name: leukocyte-associated immunoglobulin-like receptor 2
  ENST ID: ENST00000610651
  CDS Start-End: 364-595

SEQ ID NO: 148997 - DNA, 2139 bp, Homo sapiens
  Payload ID: 9428
  Gene Symbol: LTA4H
  Gene Name: leukotriene A4 hydrolase
  Uniprot ID: P09960
  ENST ID: ENST00000228740
  CDS Start-End: 143-1978
aagaaacttcctttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttcttata

SEQ ID NO: 148998 - DNA, 1908 bp, Homo sapiens
  Payload ID: 9428
  Gene Symbol: LTA4H
  Gene Name: leukotriene A4 hydrolase
  Uniprot ID: P09960
  ENST ID: ENST00000413268
  CDS Start-End: 146-1672
attctcctgcctcagcctcccgagtagctgggactacaggcgcatgtttgtcttttaaagcaacaagggaagagggcaagaggatgcatgggcttgggagtttattttctctcctcctgtctacacctcctctaatctgtctcccatgctgccacagagaaatctttctaaaagacaagtaccgaccatgcatatcccagttaagactcgtcgacttcttgcagccttaaaggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagaggatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaatta

SEQ ID NO: 148999 - DNA, 1810 bp, Homo sapiens
  Payload ID: 9428
  Gene Symbol: LTA4H
  Gene Name: leukotriene A4 hydrolase
  ENST ID: ENST00000548852
  CDS Start-End: 123-521
gtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaatggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagaggctcctttcttccaaggaatcctgttgaaatgatacggtatacttctttattttgctcttaggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaagg

SEQ ID NO: 149000 - DNA, 2025 bp, Homo sapiens
  Payload ID: 9428
  Gene Symbol: LTA4H
  Gene Name: leukotriene A4 hydrolase
  Uniprot ID: P09960
  ENST ID: ENST00000552789
  CDS Start-End: 103-1866
atgtttgtcttttaaagcaacaagggaagagggcaagaggatgcatgggcttgggagtttattttctctcctcctgtctacacctcctctaatctgtctcccatgctgccacagagaaatctttctaaaagacaagtaccgaccatgcatatcccagttaagactcgtcgacttcttgcagccttaaaggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagttgagctacttcttctta

SEQ ID NO: 149001 - DNA, 1616 bp, Homo sapiens
  Payload ID: 9429
  Gene Symbol: LTB4R
  Gene Name: leukotriene B4 receptor
  Uniprot ID: Q15722
  ENST ID: ENST00000345363
  CDS Start-End: 322-1380
ttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaa

SEQ ID NO: 149002 - DNA, 1627 bp, Homo sapiens
  Payload ID: 9429
  Gene Symbol: LTB4R
  Gene Name: leukotriene B4 receptor
  Uniprot ID: Q15722
  ENST ID: ENST00000396782
  CDS Start-End: 333-1391
ctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaa

SEQ ID NO: 149003 - DNA, 4110 bp, Homo sapiens
  Payload ID: 9429
  Gene Symbol: LTB4R
  Gene Name: leukotriene B4 receptor
  Uniprot ID: Q15722
  ENST ID: ENST00000396789
  CDS Start-End: 1726-2784
gccattctctcacatcccgtgcggtcaggaagcccttcctgaactctgacttcagttcttgctgcggtttctgcccatttttttcatatcctctgacagctgcgaggtcatctctgctctggcttttctccaagcagaacaagtgggggctctggaaaggttaagggacctcagtggccaccattatactttgcatctttcctgagaagtgagagttgaaagggaagcaggaaggcccatggtcagattgaaggaaggactttttagtttcttttttttttttttttttttttgagatggagtctcgctctgtcattcaggctggagtgcagtggtgcgatctcagctcactgcagcctccacttcctgggttcacatgattctcctgcctcagcctcccaagtagctgagactacaggcacatgccactacacccagctatcttttgtatttttagtagagacggggtttcaccatgttggccaggctggtctcaaactgctaacatcaagtgatctgctcccctcagcctcccaaagtgctgggattaccggtatgaaccaccacaacctgccaggaatttttagtttttagcttttgcaggagacttcaaggaaaggagacattcctctgtccaggaaacgggtaaggggaccatttctgcattgctggtttcccctcttggcagggtgggcatgaggcatcactgttcctgctccctcactcctgctcctcatgctcagcctgccagctcggcctcaactttgtgtgtctaaagtggaactgaatagtaggctgtgagaagataggaaagaggtagtgccaatctccttgcccagatcataaatccagactcagcagggtaaccacatgggcaagcacaaggtaggtgcttggggaaaggggaagtaattggcattctgtgtgataccaaggagaccatttggattttggcttctaccaaagagaatggagaattggttgacctaaatggaaccagtccctttaagtaaggggaggaaagggggtgctggaagatggccctcttcccaccacctagatcatagcttgaactgaagccaaggacagagtgctgcccccttcggcatttactgatgtgccctctttaaatcatgatgttatctaacccaaacccagacccaggacctagtcacagctccaacctacacttcctattaatcttaaaacaaagcaaaacaaaacaaaaagatatcagcattgtagcctccaatctgagcccatttcccttctctggctaccatacctccttctcctatatgataccattcactactttgttcaattatccagtctagacctgcatcttgaggccacacccagccttctcactccccacacccctctttcctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagaggtggagcaaagtgagggccgagtgagagcgtgctccagcctggctcccacaggcagctttaaccattaaaactgaagtctgaaatttggtcaaccttgtgagtggggtacatgtgctgtgggtatcggggtgctcgtgggcgccctggtggggcccctctcggtagttgagagtcacgtcctttagttccccatgatttacaattttggaagggacacaaagaaacatagacttcccccatcccagatgattccgagtacatagtctgcagataatacttagcaaaacgcagtctacagactcctaaagcagcttgtctaggaagaccacccatgtgggcttatcactccaggttctgtgacccgggaccttctgagaaaacagcactgctgtgaaatatcttccttgaagcctgtgataagtctccttgttagaatgactccaacttcctgccaataatctttgtcctctccataggagatgttctaggggatgccttccttccctccatttcacaaagaggccagacttgaggactaagtcattagatcttatcccttagaattttgcatatcagcatctgctaacctccacaacacaccctggcacagggtggggctgagggccccaggaaacaaagattcccaaaagtgagagggatgagtcattatttcctagagatgactgttgttttagagaaccttggtccaactctgttctgacaaggttttaggaagatggcaacaacagtggcagcagtgtactttttggatctttctcataaaaaaacaaaagagcaagtaagagagggaaaccaaatatccacatgcaacatccgcaacaaatctagtatgtcaaggtttgacatactcccatggaccccaaagtatgagccagtgagaatgagtcatcaatatctcaagacccatataccagcatctgtgcagaaggatgcagaaggaagcaaagggatgttggatggacctaagaagaggagatccccaagctgtctacagatccttactggaaggtatggtgcaccaatttgagaacagcagctgaaactgggagggacctaacggagtatttcccagtcctctcgcccattctgtatggtgagcacataataggtacttatttagtgtttgtcgaattaataaagttcaaatgacatttccctgga

SEQ ID NO: 149004 - DNA, 431 bp, Homo sapiens
  Payload ID: 9429
  Gene Symbol: LTB4R
  Gene Name: leukotriene B4 receptor
  ENST ID: ENST00000553481
  CDS Start-End: 125-431
gggcggagccggccaggcggcgcgagcgggaactacggccttggccttcttcagttctagcgtcaacccggtgctctacgtcttcaccgctggagatctgctgccccgggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacg

SEQ ID NO: 149005 - DNA, 797 bp, Homo sapiens
  Payload ID: 9429
  Gene Symbol: LTB4R
  Gene Name: leukotriene B4 receptor
  ENST ID: ENST00000556141
  CDS Start-End: 102-797
gagacttcaaggaaaggagacattcctctgtccaggaaacgggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggctccgaggcgtccagcacgcgccgcgggggcagcctgggccagaccgctaggagcggccccgccgctctg

SEQ ID NO: 149006 - DNA, 3092 bp, Homo sapiens
  Payload ID: 9430
  Gene Symbol: LTB4R2
  Gene Name: leukotriene B4 receptor 2
  Uniprot ID: Q9NPC1
  ENST ID: ENST00000528054
  CDS Start-End: 1618-2787
aaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgatcaccctgccagtcttttgtcttgggcaatctatacttttctcagaggttcccaaggcctactgaagggacttaacatactcttaatggctttcctctctcttgttttaccttatgccctcacttcctgagttaacctcccaaatacaggatcacctgtacccaagcccttagctcaagaatacaggatcacctgtacccaagcccttagctcaagctctgctttggaagaacccaaactaagacagtgctcctggtgccctccccaagcaacctcaagttctggctgttacttgagcagaggcctttcttttcccttcccccagctctatccatctgccaggcccccctcaaatctcttcatttccaagttttgcttgacttttccaagaggagagggctgcttcttagtatgtccctactcatcctttcctttcttgtcttgtatcctggtgcagcctggtaatggggcctcttcatggttgtgtgtcatgactccctaaccattatgcctccatgcatcccctgttcctcctggaacctagcaccatgccttacatggaaaagctgtcattgacagcccggtgagagccctgagggtggagtgactggggcagggcctgaggcaagaggtgggaggaggtaggaggccaggggctcagccggaccaggagactggaaacaggcaaggataaggcaggtgggggactgagttgtttgggtcacctctgcaggccagagagaccaggcaacatacacactgcagaaggtgggctgggaggattggggccagagctgggggagggatgagaacagaagcaggaccaggattcagcagagtcctcctatttccttccaccaccagggaatcttactgccccacttcagcttgtgctgtttcctggcaaggcaggctctcacatgcctggacgcctgggtgcgttggtgatgggaaggagcagggtgagggaggggccccaggagaggcccaggatgagcctcatcttgtccctccccattcttgtcttaccctctgcaaatgtgataggcacaggacaggagtaggcacctcgcctactgctgcttaacctttcagcttctccaggcccccaatcctgcttgctcccagcttggtaagtagatctgtgcacgtccctttacaccccaccatccagttttgcccagatgtgctagaatggggctggacaaagaaggaggggccagactagaggagtggtggtagagatagtgacagcctggggtgatgactttatgcctgtttaccactgagctctgggaaggaggccaggagtggggcaggtcaactgactgggagcaggggatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcagtgttctgggacatttggggacccttctttgactagagtttggatctggctgggtaggattactatacacttggggcaggcccaggctcctccaaactgagggattatgagggtggtgatggtccctgttaaggactattgtgtgcttgcaagttggcatgtacccatgtgccagcattgcttacttgttgccaatagctgttattgtgaaatacactgggaagccattagatgatga

SEQ ID NO: 149007 - DNA, 1515 bp, Homo sapiens
  Payload ID: 9430
  Gene Symbol: LTB4R2
  Gene Name: leukotriene B4 receptor 2
  Uniprot ID: Q9NPC1
  ENST ID: ENST00000533293
  CDS Start-End: 127-1203
attcttgtcttaccctctgcaaatgtgataggcacaggacaggagtaggcacctcgcctactgctgcttaacctttcagcttctccaggcccccaatcctgcttgctcccagcttggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcagtgttctgggacatttggggacccttctttgactagagtttggatctggctgggtaggattactatacacttggggcaggcccaggctcctccaaactgagggattatgagggtggtgatggtccctgttaaggactattgtgtgcttgcaagttggcatgtacccatgtgccagcattgcttacttgttgccaatagctgttattgtgaaatacactgggaagccattagatgatgacttaagt

SEQ ID NO: 149008 - DNA, 1108 bp, Homo sapiens
  Payload ID: 9430
  Gene Symbol: LTB4R2
  Gene Name: leukotriene B4 receptor 2
  ENST ID: ENST00000530080
  CDS Start-End: 152-1108
gcacaggacaggagtaggcacctcgcctactgctgcttaacctttcagcttctccaggcccccaatcctgcttgctcccagcttggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgc

SEQ ID NO: 149009 - DNA, 710 bp, Homo sapiens
  Payload ID: 9430
  Gene Symbol: LTB4R2
  Gene Name: leukotriene B4 receptor 2
  ENST ID: ENST00000527924
  CDS Start-End: 230-710
gcagcagtgtggaggtccaacgaaggagctccctgaatggcagagacaagaggaaatcagatgatttggaaaacttgggaggaagccatcaagctgggagatgaggactttccacaagcaagagctaactaggggcacaggacaggagtaggcacctcgcctactgctgcttaacctttcagcttctccaggcccccaatcctgcttgctcccagcttggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgcc

SEQ ID NO: 149010 - DNA, 1560 bp, Homo sapiens
  Payload ID: 9430
  Gene Symbol: LTB4R2
  Gene Name: leukotriene B4 receptor 2
  Uniprot ID: Q9NPC1
  ENST ID: ENST00000543919
  CDS Start-End: 172-1248
accctctgcaaatgtgataggcacaggacaggagtaggcacctcgcctactgctgcttaacctttcagcttctccaggcccccaatcctgcttgctcccagcttggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcagtgttctgggacatttggggacccttctttgactagagtttggatctggctgggtaggattactatacacttggggcaggcccaggctcctccaaactgagggattatgagggtggtgatggtccctgttaaggactattgtgtgcttgcaagttggcatgtacccatgtgccagcattgcttacttgttgccaatagctgttattgtgaaatacactgggaagccattagatgatgacttaagt

SEQ ID NO: 149011 - DNA, 666 bp, Homo sapiens
  Payload ID: 9431
  Gene Symbol: LTC4S
  Gene Name: leukotriene C4 synthase
  Uniprot ID: Q16873
  ENST ID: ENST00000292596
  CDS Start-End: 96-548
cttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgaga

SEQ ID NO: 149012 - DNA, 486 bp, Homo sapiens
  Payload ID: 9431
  Gene Symbol: LTC4S
  Gene Name: leukotriene C4 synthase
  ENST ID: ENST00000401985
  CDS Start-End: 89-370
tcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccga

SEQ ID NO: 149013 - DNA, 582 bp, Homo sapiens
  Payload ID: 9431
  Gene Symbol: LTC4S
  Gene Name: leukotriene C4 synthase
  ENST ID: ENST00000505170
  CDS Start-End: 97-306
tcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctcc

SEQ ID NO: 149014 - DNA, 1833 bp, Homo sapiens
  Payload ID: 9432
  Gene Symbol: LPXN
  Gene Name: leupaxin
  Uniprot ID: O60711
  ENST ID: ENST00000395074
  CDS Start-End: 90-1250
catccagttcctttgcggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataa

SEQ ID NO: 149015 - DNA, 1879 bp, Homo sapiens
  Payload ID: 9432
  Gene Symbol: LPXN
  Gene Name: leupaxin
  Uniprot ID: O60711
  ENST ID: ENST00000528954
  CDS Start-End: 121-1296
actttttcttactttttatctgggcgttggcgtacctttctcggggtgtctgcgtaactgcccagacttgccttggtttggtcagatgacacctcctctgggactggctagccagcgttcatgtctacattattgatctcgtcttccgatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataa

SEQ ID NO: 149016 - DNA, 2099 bp, Homo sapiens
  Payload ID: 9432
  Gene Symbol: LPXN
  Gene Name: leupaxin
  ENST ID: ENST00000530561
  CDS Start-End: 65-385
cttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaagtagagacggagtttcaccatcttggccaggctggtctcgaactcctgacttcgtgatccacctgcctcggcctcccaaagtgctgggattacaggcgtgagccactgcgcccggccaaaaggactgttaaagagacctgactaagcaggacagaggagaccagtgagcaagctgagacacagcaagggagatcaaagtatggctctgacagtaggaaggatgagaagtcccaagcccatattgagataaaatctgcctctttgttctagcctctagaacacctctaaagtggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataa

SEQ ID NO: 149017 - DNA, 1751 bp, Homo sapiens
  Payload ID: 9432
  Gene Symbol: LPXN
  Gene Name: leupaxin
  ENST ID: ENST00000528489
  CDS Start-End: 236-1336
acatccgggctcaagcgtcgagccaattgctggtctgatgggagggtttttcctactttttcttactttttatctgggcgttggcgtacctttctcggggtgtctgcgtaactgcccagacttgccttggtttggtcagatgacacctcctctgggactggctagccagcgttcatgtctacattattgatctcgtcttccggtgtgtgagtcactcacctgtgagctcctagagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccgtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccattt

SEQ ID NO: 149018 - DNA, 2377 bp, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENST ID: ENST00000222725
  CDS Start-End: 21-1160
cgcgcggccgccaccccaccatgctcaagcgctgcggccggcgcctgctgctggcgctggcgggcgcgctgctcgcctgcctgctggtgctcaccgccgacccgccgccgcctccactgcccgccgagcgcggccggcgcgcgctgcgcagcctggcgggccccgcgggggctgccccggcgcccgggctgggggcggcggcggcggcgcccggggcgctggtccgcgacgtgcacagtctgtccgagtacttcagcctgctcacccgcgcgcgcagagatgcgggcccgccgcccggggctgccccccgccccgccgacggccacccgcgccccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaa

SEQ ID NO: 149019 - DNA, 1968 bp, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENST ID: ENST00000338732
  CDS Start-End: 1-753
atgacaccaggtcgctgctgtcttgcggctgacattcaggtagagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagc

SEQ ID NO: 149020 - DNA, 1377 bp, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENST ID: ENST00000359574
  CDS Start-End: 1-1086
atgctcaagcgctgcggccggcgcctgctgctggcgctggcgggcgcgctgctcgcctgcctgctggtgctcaccgccgacccgccgccgcctccactgcccgccgagcgcggccggcgcgcgctgcgcagcctggcgggccccgcgggggctgccccggcgcccgggctgggggcggcggcggcggcgcccggggcgctggtccgcgacgtgcacagtctgtccgagtacttcagcctgctcacccgcgcgcgcagagatgcgggcccgccgcccggggctgccccccgccccgccgacggccacccgcgccccctggccgagccgctcgcgccccgagacgtcttcatcgctgtcaagaccaccaaaaagttccaccgcgcgcgcctcgacctgctgctggagacctggatctcgcgccacaaggagatgacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggtggggaaactgaggcacggagcagctgatgcccaaggtccagcagccatgctggtgggctggggaggcgctcagactccaagccaggcaggccgtgggtccggccgccccacagctggtaatgctgcacctccctctcctgtgatgtggccccaggccccgaccccgctcaggggtggtgggaagagtcctggagagcaggagcagtgccggagcccccactgcagctggtcccagcccctgcagagatccagacgcttgttttttaaatacagcagctctgcggtgcttttccttcctcaaa

SEQ ID NO: 149021 - DNA, 2058 bp, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENST ID: ENST00000402045
  CDS Start-End: 89-841
ggagggttttgctctttgtgtgggtgtgtgagtggctatgatcctagttgtccagctgctgcgtggagaataagtaaagcaggtctgaatgacaccaggtcgctgctgtcttgcggctgacattcaggtagagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagcaa

SEQ ID NO: 149022 - DNA, 2268 bp, Homo sapiens
  Payload ID: 9433
  Gene Symbol: LFNG
  Gene Name: LFNG O-fucosylpeptide 3-beta-N-acetylglucosaminyltransferase
  Uniprot ID: Q8NES3
  ENST ID: ENST00000402506
  CDS Start-End: 127-1053
agactaagctgcaacactggcagagcctcccaaggaagggaggagggaggacagaggccaaggcggctcctggccaccctcgcagcttcctccctccctggccacaaggacccaaagctcagagggatggatgaacagacaggaaggctcaggctggacacgtattgtatgagtgccaagcagatctgggcatggagcaaatgctcaggaaggctgtgggatgagcacatgaaatggatggaaggatggacggacagatggacagatggatggatggatggatggatggatgagtggagcccaacaccagctctcaggtcctacggaggtggcctctctcagcagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagc

SEQ ID NO: 149023 - DNA, 1969 bp, Homo sapiens
  Payload ID: 9433
  Gene Symbol: LFNG
  Gene Name: LFNG O-fucosylpeptide 3-beta-N-acetylglucosaminyltransferase
  ENST ID: ENST00000614382
  CDS Start-End: 8-754
ggtggggatgaagggctgcctgctgaaggccgattttctccttcagacgttcatcttcactgacggggaagatgaggccctggccaggcacacgggcaacgtggtcatcacaaactgctcggccgcccacagccgccaggcgctgtcctgcaagatggccgtggagtatgaccgcttcatcgagtccggcaggaagtggttctgccacgtggacgatgacaactacgtcaacctgcgggccctgctgcggctgctggccagctacccgcacacgcgggacgtctacgtcggcaagcccagcctggacaggcccatccaggccatggagcgggtcagcgagaacaaggtgcgtcctgtccacttctggtttgccacgggcggcgctggcttctgcatcagccgtgggctggctctgaagatgagcccgtgggccagcgggggtcacttcatgaatacggctgagcggatccggctgcctgatgactgcaccatcggctacatcgtggaggccctgctgggtgtgcccctcatccgcagcggcctcttccactcccacctggagaacctgcagcaggtgcccacctcggagctccacgagcaggtgacgctgagctacggtatgtttgaaaacaagcggaacgccgtccacgtgaaggggcccttctcggtggaggccgacccatccaggttccgctccatccactgccacctgtacccggacacaccctggtgtccccgcactgccatcttctagtggccatggctgagacccaatccctgggcgcccctggtatccaaagggcccagggaccctgttgcgctgccctggcctcggcattcgaggctcccctagggccgtgcctgtgcgtgtgcgtgtgcgtgtgtgtgtgtgtgtactgcatgcccacccgggtagcaggctgctgggcagttctgctctgtggaggggcgggcaccagcgccacttatgtgcctctgctccgagggccagtgggctgcagggcctgcttggaggaaggatttgtgtgtcggaggccactccgagggcaattctgttaggatttttggatctttctacagctacggggctccgggctactttgcagggatgcgatgcgtaggtgcctttctcttcctgctgaccacaagctctgtgctgggggtacctgtgccctgaagtcctggcccctgtgtcatagccccaagtacgactcactgagccatgctcattgcaggggaggctgggtctgggggtgcgtgacccaatccccttcctcctggcctggacgctgtggcttaagagtaacagcagccaccgcccagttccagtggccccacgaagcccccagtggctggctgtccagctgggcaaacagtggcacccctcccagctcttctgagtggggagtcttccaggcctcctcagaggtcttccctttgcctccccaggacagggtgagtcagagctcagcatttaatctcctctccaaagtagagagcaagtcgcccacagtgggcgtgtctgtaaatattgtgacagtatttttttactgtgctgttttttttgaaaggggatgggtaaaaagtagggtgttcttgttttttgcttgggagggtgggggtgggggagggtcttattttatcttatcttttctgtggatcagaaaaaacagaagccaaactcggggtcatctttgtttttaaagctgaagtgggactgtctggcactctgtgtatttatgcgttccagcatctggaacctcccatccctgccctcctcctgtgtagctgccacctccccgctgggcccagcatggctcacctgtcccgtgggctgtgtttcttgttgtttttctctttgcaaagacatagctaggaaagcgaatgataagggaaaagttctcagggaattgaagtgttgttgctatggtgacgtccttttgctgtgaataaaggtgctctttgcagc

SEQ ID NO: 149024 - DNA, 4834 bp, Homo sapiens
  Payload ID: 9434
  Gene Symbol: LCOR
  Gene Name: ligand dependent nuclear receptor corepressor
  Uniprot ID: Q96JN0
  ENST ID: ENST00000356016
  CDS Start-End: 564-1865
gtgcgaagcgtgaggtggagatgggggcggagggagctggagctgtcacagtccccgggtgcgcctgaccgagccaagtggggtgtcatggccgcggggggcagcggctgcacttcctcagcgggcggcggtggccggggagttaatcctcgacgcacgggtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactattaaatttatttaaattagcaagctattagtgctcacccagaggggaaggtggtggaaaatgtgcacacactaccttcagaaatgcttcagttaattactttgaacactacctttgctgtaatttcatttgagattttctaagggtagaatttggtctcaccaacaagtgaggatatagccttatctcatggaggacgagctccgtatttactcaggagcagtcagggtacattacataaaacaatggaggatgcctcattttagcaaactaggtttctttgtattcttcagtccttttacagaattgatgtgctaactgaatatcattgcagcaactagactaagatattcaagatctctttattggggatgggagaaatagggaaagaaatgtgtataagtaattatgatattgcaaaagtgatacttagattttacagcctcagtagtctgcccagtgtccacattaatgaaggatccatgtttgtagtgagagaaaaaaaccccaaggtaacccgatatgatttaggatgcatatcagttctaacaattcaatcagaagtcaagctcattggaattccttttttaactgatccaaatactagtagaagggggagggagaggtgttgggttttttttttaagtttttatttaattttgttggttagaatttttttctgtttttggcatcctacataataccccccttcttgactttttctgataattagctgatattcatggttgtttagcacacagttcaggacctttgagatcatgtttgtataagcactccttgaagaatatctaagctttttctgagatgggcttttaaaattataataagggaagtttattttctgcggtttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttgtcattgtagtgtacatggagtgatcattttactaacataaatattttctatgtgtgtttcagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctc

SEQ ID NO: 149025 - DNA, 4852 bp, Homo sapiens
  Payload ID: 9434
  Gene Symbol: LCOR
  Gene Name: ligand dependent nuclear receptor corepressor
  Uniprot ID: Q96JN0
  ENST ID: ENST00000371097
  CDS Start-End: 547-1848
ggcggagggagctggagctgtcacagtccccgggtgcgcctgaccgagccaagtggggtgtcatggccgcggggggcagcggctgcacttcctcagcgggcggcggtggccggggagttaatcctcgacgcacgggtcggtgtgtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactattaaatttatttaaattagcaagctattagtgctcacccagaggggaaggtggtggaaaatgtgcacacactaccttcagaaatgcttcagttaattactttgaacactacctttgctgtaatttcatttgagattttctaagggtagaatttggtctcaccaacaagtgaggatatagccttatctcatggaggacgagctccgtatttactcaggagcagtcagggtacattacataaaacaatggaggatgcctcattttagcaaactaggtttctttgtattcttcagtccttttacagaattgatgtgctaactgaatatcattgcagcaactagactaagatattcaagatctctttattggggatgggagaaatagggaaagaaatgtgtataagtaattatgatattgcaaaagtgatacttagattttacagcctcagtagtctgcccagtgtccacattaatgaaggatccatgtttgtagtgagagaaaaaaaccccaaggtaacccgatatgatttaggatgcatatcagttctaacaattcaatcagaagtcaagctcattggaattccttttttaactgatccaaatactagtagaagggggagggagaggtgttgggttttttttttaagtttttatttaattttgttggttagaatttttttctgtttttggcatcctacataataccccccttcttgactttttctgataattagctgatattcatggttgtttagcacacagttcaggacctttgagatcatgtttgtataagcactccttgaagaatatctaagctttttctgagatgggcttttaaaattataataagggaagtttattttctgcggtttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttgtcattgtagtgtacatggagtgatcattttactaacataaatattttctatgtgtgtttcagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaaaaaaaaaaaaaaaaaaa

SEQ ID NO: 149026 - DNA, 4834 bp, Homo sapiens
  Payload ID: 9434
  Gene Symbol: LCOR
  Gene Name: ligand dependent nuclear receptor corepressor
  Uniprot ID: Q96JN0
  ENST ID: ENST00000371103
  CDS Start-End: 522-1823
gggccgggcgggcggcagaagatggcgagggtgtgtaggcggcagcaatgctccgttgagagacgcggctttcggcaagaactggattcgtggcgccacaagctcattcactgtgtaggtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactattaaatttatttaaattagcaagctattagtgctcacccagaggggaaggtggtggaaaatgtgcacacactaccttcagaaatgcttcagttaattactttgaacactacctttgctgtaatttcatttgagattttctaagggtagaatttggtctcaccaacaagtgaggatatagccttatctcatggaggacgagctccgtatttactcaggagcagtcagggtacattacataaaacaatggaggatgcctcattttagcaaactaggtttctttgtattcttcagtccttttacagaattgatgtgctaactgaatatcattgcagcaactagactaagatattcaagatctctttattggggatgggagaaatagggaaagaaatgtgtataagtaattatgatattgcaaaagtgatacttagattttacagcctcagtagtctgcccagtgtccacattaatgaaggatccatgtttgtagtgagagaaaaaaaccccaaggtaacccgatatgatttaggatgcatatcagttctaacaattcaatcagaagtcaagctcattggaattccttttttaactgatccaaatactagtagaagggggagggagaggtgttgggttttttttttaagtttttatttaattttgttggttagaatttttttctgtttttggcatcctacataataccccccttcttgactttttctgataattagctgatattcatggttgtttagcacacagttcaggacctttgagatcatgtttgtataagcactccttgaagaatatctaagctttttctgagatgggcttttaaaattataataagggaagtttattttctgcggtttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttgtcattgtagtgtacatggagtgatcattttactaacataaatattttctatgtgtgtttcagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaaaaaaaaaaaaaaaaaaaacaaaaa

SEQ ID NO: 149027 - DNA, 7777 bp, Homo sapiens
  Payload ID: 9434
  Gene Symbol: LCOR
  Gene Name: ligand dependent nuclear receptor corepressor
  Uniprot ID: Q96JN0
  ENST ID: ENST00000540664
  CDS Start-End: 544-1764
gcgcggggccgcggcggaggctgggccgggcgggcggcagaagatggcgagggtgtgtaggcggcagcaatgctccgttgagagacgcggctttcggcaagaactggattcgtggcgccacaagctcattcactgtgtaggtcccgtttccctctgtgcggcggccggcgggaccataagggcttaactcatatatttaacccccctccaaaaaggtttgaaagtattcttgaagggctgtttggacctgcattattaaaagatctcagtttatttaaagactgtgaacctgaaagcatttctgattggacttttgatgaaaactgtttattctgttgcttgagaagagataaagtaaagggacacttagtcggtctggatgaaccagcttcgggagctgggcaagaagctctgcttaaacaagagcaagcaaaaatcattcgattcgagagacaagcagaagaattcctcaatgcagtcttttatagaaaagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaagacggtgtacttgatctgtccactaagaaaagtccatgtgctggcagcacttccctgagccactctccaggctgctccagtactcaagggaacgggcgacctgggagacccagccagtaccgcccagacggacttcggagtggtgatggggtacctccaagaagcttacaggatggaaccagggaaggttttggacactccacatcactcaaagttccactggctcgatccctgcagattagtgaagaactactgagcagaaaccaattgtccacagctgccagccttgggccatctggattacagaatcatggacaacacttaatattatccagggaagcctcttgggcaaaaccacattacgagttcaacctcagccgtatgaagttcaggggaaatggtgcactcagcaacatcagtgaccttccttttcttgcagaaaactctgcctttccaaaaatggcacttcaagcaaaacaagatggaaaaaaggatgtgagccattcatctcctgtagatttaaagataccacaagttcgaggaatggatctttcttgggagtctcgcactggtgatcagtacagctatagctctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgagtggatgacaatcgagcagcagaagaatggtgtgcctaccctttaatgctgcagtttaagagaacttgtattgtgtcatttcagattgtaggctgagagttgtaaatagtgaaaatttgagtacttctattatttgttttggttagaaagtgaatttaaaaaacaaaccaaactctaaactttctcagattaaaagtcctgagacctgaagattgtaatattcatgtctgtgaagcttttaaacattacacttgagatcagtcatgacttgatattcaggtaaattttcttttccaagaagcttttgaataagcatatttcctccaaaggtctctctctttctctctctttttttgagtgtagattattttaaagcactaattgcattacattggtaactgcaatataaaatagccattattgttttgtgaagcatggttgaaattagctagtggtcccttttgaatttcatgagcctctcaaaaaagaaaaacttaaaaaaaaaaaaaaaaaaaaacaaaaagctgctggaatatttcaaaagatatatattttaccttattataggttttgtaaagttagtttgtaatattcaggtgcacttttaatgttaaattttgtgttcagagttccattataccatgtatttctcggaggtggctcatcacacggctggtggcagtcttggtgccgcagtgattccttaatatttgatttctctcttgatttgccactattctgtattggcactttcagtgtagatattctagtttggggatgtcctcacaatgtgtaatagagattggtctattagcatgcttaatttctgctaatcagagttttgcatggcccaaacaacagttgaccatttttatggtatgggaaagtgtagttcacaactgtctttgtcacgaaagccgtttttcctcacattttccagtaggcagataacattacttaaattattaatatataacactcttggaactattgataggaaataatgtatttaaaataattttttgcattttcagagaccttgatgttatagggtagataagctatggcactataaaatcaaaaacactaattctgtggaaggatatctagttggtatttttatctttagctttctcatttctgagacagcatagtcatccagcttgatggtaatgtagtatattactttgttcagtgggcttataagtgactctgaattatgtttgtgatgagctatacactttttttctgttccccaaataccatgaaggacaaggtcactctttcaggaaaaataatttatatttgtgtataatactttttaatattaagtttgttgttctgaagtttagatgttgcttgataaacctttgctgcagcagatcatgaatatgagtaaggctttgtgtgataataggggtccttatgtgaagttaattactgttcagttctggtgagcaagctcaacaagtgtgaagtgtgtattagctttatttggtacacttttactttacaatatcgaagtgcttttagaactctggttatcttatataaaccattacctcaaccaattggcatttcttttccccaacatttaccttagctataatatgagctatgtgggatcagatggtaaaactataaaaggcacaatgagaagtttagttcccaagttttggagagaactctaaattagactaaaaacaactacctgttaacaccaatatcataactaccttctgtcgttaggcagtacatagcaacctttgagctgctagtgagctatctgttctccccctacccccaagtaagcacacagtgccaggcctggttctaagcctttgtgattctcttacatctcattgacccataatagtgaagcatggattcatttattttcataagacaaattgagtcagctcgatgtcagaagttgaaaatattttgagtagtttaacagttatatgagagattggcatcattttctttaacagcttttatctttgtagatttccttttgagacatgtatttttgcttttataatcctttcattaaatgccagaggttgttttcatattaatcactcttttctgtatattcaggttgctgtcattggtgatagaatatggcaatagacagaattgtgctccactttatgttttttaggagatattgaaagttataggttaaattttggccttcttgaagatatcaaagattgttttccttgttacctttaattagaatttggtcttcattaatgctttggtcaggctagcattactaaaaacttgatggcttcagcagaacagcccgtttaggagactattaagctatctagggattttttttcaaattaattgctttcaaaatctgaaaaggaaaaaagtataattgtggtacaaagaagacagatctccaggctctttcttctcagtttattttggtttaattctgtactggagacttgaataggatttgtgaacatggtgatggaaagaaaaatagaggacattatttgtgtaccctcattcctgaataatcttgcagtcaccttttaaagaagcagacattagccctgtaacacaacactgtagctataaactctaagtgttaggaaggagattggggtggggagggtggagtaggatggaaaaagcatgtagacttctgagaagaggctaaaaattctgccctataatactaaaaatgagtcacaagataatgtggtgaagttaggccatcttgatttgatagaaaaatcttttacattgtttaaaaatgagaatcgaggctaattaatgttgatttgacaatagaacatgagctaattctgcaaccgtttggggggtaattttatggtttccagttcatttagagctgtatcaagaaaagctaaaaagcaagcacttttagttaatcatagatttattggatatagcaaatattattataatatttaatctctattatttgaatgtggaaatgaactcttttaccccatcttgaactgtcattgaacatgctcaagatgatcaacactggaaatgaccctacacacataccaaaaaaatctaaagcagtaagacatatttgaagatccatacctcttaaactttttagatttgtcttgggaaagaatttatgaacctgtaaccagtattagtgcagtcttgggttccttgttctgcataattgcaccctttctcaggtatgtcctgacaacataaattttaaaataatctcattagagattagattctcagtggatagtgtgtaaggggactaggggtggggggttgggggtagttggacacaggacactgacacagtagagcagggatttttaacagtcaatagccaaatagaatttcaatctagaatatttttaccccctcagaatgagtgaaacaacttctattatttggtgtacccggtgctacactcctaaaagtcttttttttttttcatccaggtgacgttttttatttttcctgcttggtggtggaaggttatatagtaaacttcactgtcattaagaaagcgcttgtccaaaatgtttaaagtactagaaaagggataattcagcactttttctgttacaacactaaagtcttaatttatcttcagagtcttaggtactgtaagtttttggatgattatttaaaaatataaaacatactacataatatggggtcagatcacatttatataaataattcttattttaaaaaagacaataacattttgtacctttctagcaattccaagtgattgcctcattttctcttgttaagcatttcaagcttaagaatttggaatttgagagaaggtgagggggaaaattccctaaaataaaaatttgtttcaaaccattttagaaaaataaatcactaggaaaataggtagggattctctccccctttaagtcttcagggaatgagcagtatttagaatctttggctgaaattcaagcctttttactttgtaaatttttaatattaattcactgacatgctttttacaccagaggactgaaaatggatcttaatgtttttaagttgtggaagggtatatttctaaaatgaggggggatgattaactaggttagtattaccagcattagtaagtttaaggaattttagtatgtaatagcaaagtgtttgattaaaagtctaatcctatattactagtcaaaattagttacattctgatctaggaaagataatagtcattggatattgatatgctgtgctgtcagaaaaccagactaagatagaaacctttatctgactcccacatgttgcttgttgtgatgggatgtatactttacagcagcttattgctgctttgaaaaaaaatgtataaactatacatttggagtgtttgcatataattctttataacctccacttaaagctgtcagacattggtattttatcagtccacattgttgaataaaactaatgttcttaggaatccagcttgtacacactgtttaaaaaccctcagggacagtttacacactcttctcactcaattcaggtactttgatgctattcttaaacctaacagtgacttgtatttttctgttttgcttttatttcaacgtgctggtagcacatctgatgaatgtcaacttaaaaaactcagttcaggtatccaggtataactcagccaaacagattttaaagctgcatataactctccagcacatggtgcctcacactcttatagtggcattctatatattcagttattactactgagcagataatatgggggttcctgttaacagtgtattttttaaaaaaagcgcataaatgtatagccagcacactacacacacacacacaaacatgcacagttaaactatatatttttaaatgccactaatagccagcacaactaaaacaaaagacattcctaactgctctgtaagctgttaacagatgcagttccttcttgatgtggctcttgcttcttcacgataactactactaaattcaagcactggtccttgggtgtctgacctctacattctagtttatgcaatgtctttagagaattttgtgcactggccactgtgatggaaccattgggccaggagtgctttgagtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattccagtgttttagtcctttgcatctttaatgttaagacttgcctctttaaaattgcttttgttttctgcagtactatctgtggttaacaaaatagattatttctctgctttaatatttgatatcttacatctaaaataaattctctccacatataaaacccatagcctttggagatatggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtccccccccttttttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattcttctaataaattttgttgtg

SEQ ID NO: 149028 - DNA, 5604 bp, Homo sapiens
  Payload ID: 9435
  Gene Symbol: LCORL
  Gene Name: ligand dependent nuclear receptor corepressor-like
  Uniprot ID: Q8N3X6
  ENST ID: ENST00000326877
  CDS Start-End: 126-1082
gtgacacgtgtcaatcaacccccctccggggggcgcgcgctccggggctcgcgccgagggctcgcgcccctgcctcgtgcctgcgctgctcgtatgtaaatgagggcgcgtgacgcgggacgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctggcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgttttttttacatgttttacatcagatcattgtggaattttgtaaacggattttgatgtttctcttttagtggtattatgtgaattttttatgccctaagtttaaatacgtaattgtccctagttttatttctgtgcacaaagttttaatatataacacattgtgatttataaagctagtattgtaaagatttgtgatgataacctgacccatgagcagttgtaaaacaggtggataccaactacctcgaagcaaattggtgaaagaaaaggcaaaggtatctcttagaagtaaatctccttcaacgttatatatgtacagaagaaaaaaagttgatcatagctttttgtcaagtagcatgtttcccattcacaggaaaatgtgagcttatcagttctttctctgtattttaaatctaagtctgtgggctttaagagcaatggcacaattgcatgtttactgttcagcaaatctgtgcctcttgatagagaaaaatactatgtggtttctgtaagttaccagttttgaatgaaaaatggtaaatggatttacatctgttttattgtaccttagccttttattttaaagttaaagggatgacttttaaaagcaggacattccctacctttaatagtgcaaagcacagtttcagcaatggctacatgactatgtctaaaaactgaatactcagaatactaaaggtttggtgcttaaatttatttttcccatgccagagaaagcaagctttggtatggtaaaccacatgagaacatggctcctttctttttggatagcctggccatgtgtgaatgggattttagcttattatgtttctaagacttttccttacagcacacttaatgtaccttttcagtccttctcccaaccccctgcaaattgtctttaaaacaacaacacataaggaatctgaagcacaggagaacacagagccaacaaacagaatgaagaacaatcatctatttttaactgactttctatcattaccatttttccttttgcttaataactatcttgctttgaaactttgactccttttataagttctatgaggcacatatgtatagcaatttggttctaaaaaccagtgatcttactttagctccatcttaaaatttcaccttaagtaaatggcctctagtagatgataagcctaaaaaaagcacaattattaaaacaaacagatccatgttaggacatttctgaataataaagagaaaaggtgtttcgttgggtattgcagaaaagaggaccaatttcatatagtacaagtttcgtaagtcaggccaagtgtcaatttcaaaagacaagaaatgaaattgacagtgaatagtgctcataaattggtagcgtatataaagagaagttcctgtcacattatattcccactagaattattatccacagtaaataaatattattttgttatgccaaaaatatagcgagcagcttcatggttaataatacatttatgttgacacctccctaatccaggaaacattcacaaacaaggactcccatatacaaatactttaggaagagagatttcccaggcagatatcaccaaaaatgttttcactgtaggaatcacaaaataagtttttgtcaaaataactgttgttgaacgttatactggtcttcctcactggtgattgataagctcctttctagccagtttgtggtacttccttcattttccctagaaatgttacttgttaaatgtgtcctcaggcggtttcatctttgttgattctgcccatctaagtcataagcttctcaaatgcaagctactagctagttacacttgtaagttttccataatgacatgattttaaacataaagagttcataagaatcacttggagagactatttaaaaatgagattcctaggcccacctcagattgtgataaatctgtgtgactgactgatgcacactttttctggactataataactgatgctgctctactgctttaatacaggccaaagtaacgtggaagcgcacagcagaaaatcttcagaaagacatcaggtttgttctgattttgacaagggtaacttcttctttattaaagcaaataactggacataatcttaaaggattccacctccatcgtctttcctaacttagatcttcattgagaaattgggcaaggttaagtttacttttttctagtgctgcggttttggctcgtcttggtagtctcatcttcatttctgattctggttctggaacttcatgatcactaaatagatgttgaaaatacacgaatttagatacaagctttaaaaccagtttatttataaataaaacttttttgtttctgactcacattctatcagtgtttaattgatagcctgattccattgacttagcttaaaactaaaatctcaatgtcaaaaaaacactgacttggctatctagcaaagtgaatcagggaaaatctagctaatgattttatatactataacagaacctggtgttatacaggaaaaaaagccacaaacttgtaatgaagcttgtaattaaacgaggaccataactgtccaaaagagatttctttgaaactcaagaagtgacaaaaaaattaagttctctctcttgatttaagcaataaattccaaaaacatagtaaaaaacaagtttccccccaaaaaagacaaatttaatcaacagtgtaaaactatgtactgaaaatacacacaatacaattttgcaaatgaatacaagacagctaccaactttcagctctaacagtggcttgactgacagaagccaaaaataaaacactctaccacacaatatacccaaattatagacagaattattctatcagtatgtaagtgtagagaacccaaatattatcaaaatcaagagtttgctaactgaagatcaaagaggagtcacatcatgtaattaaaaattgaaacaacatattaaagatagtactaaagaccatgccagctaataggcaaaagcaaacacgccgtaagaagtcaaatgctcttgatgatggaattttagactatatacctaagacagctatttatagttttcactatcttgttatatattctctctcattcgcaagaaaattagtttttttctacttgtagaaataaaaagtgaagataggcctccatatattctagacatgcatgacatacctttcagagtcggcttcagcagtctgacacctcctgttcgtcctagctgaaactgtcacttttctctgtccttgaagatagtataattcattatcaggatttattatcagttgctttttgtttttaatctagtttctaggctaactaaatcctttgtcttcaacacaacaatcctttcaacacatgtatctcctacttgttctagccatcttggtaccagttatcactgccacagaaaaaggaacccaagcaagattaaaacttaatttattttgtaagcactaataatgagtaagggaaaataaggaaatttcaagcaagttaaaagaaggcaaattttagttcaatgtatttgaggacagtatatgaaaaatgtgttataatgaagtacctctattattgctatagcacaaagtctgtggagactcatgaaaattaagggttagaaaggtaggttaggtgcataaacaggtgctaaagaaacaacttttttttttcttggaaggtgataaaacatagtaaggtaataatggcttcttgtaaaataacatacatgaccaattcaaatgtgttctaaaatatatttcaatgtaaaaactagaacctttatatactggggattataagattctacttactagaaatttacaaggttaaggagtaagacaaagtttggcttgtgatgtttctcatttataaggaataaaacaatatgaatatatgaagtttggtctattaaaaaggatggtgttctcatggtgtgatataccacaaaaaaaatctgatcaaaaccaaactgttcaatgtgacagtctgaaaattatatactctacttcattcatgttacacttttttctactccttacctgcttttactaatgcatttatccccaagaaaacatccaacaatatgggactaatttggaacaatatccagcaattggtatttaaataatttactggttacaaaacaatattatgaccagactccattttagaaaaaattaaatctgcatcgaaaagggccttaaaaaatagatttctaaaatcaaaatcatggttggctcatgggtgggattattagtgttccttatagtagtttgtctggatgtactttctgattcttctgtaataagcatgcattgcttttgtaatgaggaaataataaaacaataaaaaga

SEQ ID NO: 149029 - DNA, 4984 bp, Homo sapiens
  Payload ID: 9435
  Gene Symbol: LCORL
  Gene Name: ligand dependent nuclear receptor corepressor-like
  ENST ID: ENST00000382224
  CDS Start-End: 303-1859
tccccacctcccatccccattcaactgcaattccctctttttggttggatctgaatcgttttgcctcaaacttctgggcttggggctctcaccctgtggattgtttagggtgacaggaatggtgggactcccgaccttgctgcagtcgcttttttttttttctttttttgcctaagacgaatgcatagagctgttatccagcaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctgggagactacacagaaacagagaggactatgtggaaagaagtgctgagtttgcagatggtttgctctcaaaagctttgaaagacattcagtctggagcactggacataaataaagcaggcatactttatggcatacctcaaaaaactttacttcttcacttagaagccttaccagcagggaagcctgcatcttttaaaaacaaaactcgagatttccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaaaaaatgaaagcctccaatatgaaacttcaaatcctactgtacagttaaaaattcctcagctacgagtaagttctgtctcaaaatcacaacctgatggttctggtctgttggatgttatgtatcaagtttccaaaacctcttcagtcctagaaggatcagctctccaaaaactgaaaaatatactccctaaacagaacaaaatagaatgttctgggcctgtaactcactcaagtgttgactcttactttctacatggggacctctctcctttgtgtcttaattctaaaaatggaacagttgatggaacctctgaaaatactgaagatggattagatcgaaaagacagtaagcagcccaggaaaaaacgtggccgctatcggcaatatgatcatgaaataatggaagaagctattgcaatggtaatgagcggaaaaatgagtgtttccaaagcacaaggaatttatggggtacctcacagcactttagaatacaaggtaaaagaaagatctggaacactgaagactcctccgaagaagaaactacgattaccagacactgggttatataatatgacagattcagggactggcagctgcaaaaacagcagcaagcctgtgtagattacttgttaggaaaatgtttgtgagtgtgtgtgtgtgtgtgtgtttgcgtgtgtgtgtatgtgcacaggtgtgtatttgtgtgtctatatacacacgtgggaattacaaatgctcactctgacaggagacatgaaattttacagttcaaaaaccacttacatgccttttgaaaaaaagttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccaggaatagaaaagaaaaccttaaaggatatgtataatgaaatttaatatttatcatttaatagttgatttagcaagaagttggggtttataaggtatatactttaaaaaaactgacacatagttaaccccagcagctatagaaccctttaatataataagatggagtactaagaacaaaaaataatttaaatttaattattaaaataatttagttttgtttttcatttgaaaaataagctaatgtgtaaggttagaaaagaaagttggaatgcaacttagagcatgtttataatgtgcacagaaaaagcttgagaatgataattttggtttaaatgtgctggttagttgatgttatgactactttaaattttaaggattgtgacacactcctactattgaaaaacctcagtgtaactttaatatatttgctgctgtgacatttcaaaacattttcagtttatcaaaatgaattgcagatttcattttggtgggcgatacattatcattttgctaataaccaaatttgcagtttgttcagggtcttgaatagatttacaaatatttaacactgaagctgttttgaactttcagtaatgtaaactctctactaattgggtagttagaagctgggcagtgcattttaacttttactagactcataagagagactggtcatttttacctagcagttttaaaatatgggtcaaagtatccttgttggatttatggagtatgcaactgtagtggtaaaatgttataaagcatatgccttcatataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctcttttttttttttttcaccccaagaaaatatacataatagattacagaacagcagatgtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcattttagtacttgtattatttatttttggtcagaaatagtaaattaaaatattttttgatagtttataggtaataatcaacccataacttttaaaagaaacaaaacatttctattattgagttaacatttgattatacaaactaggaaaggcagggaaattccccttctccccagtgattctattaagatgacctttatgttaaactttcaaagtactttatgaatttagttaccagttactatttattaattgacaattttctgaaaaatcccgtttcagcagacttaatgaaggtgaaagcaacccttatgtgctttctacttatttgaatgttcctcaagtattttatattaaaaaaaaaaagaaggaaaagagaaaacagtgcctctgtttttagaaaactactgctcagtaaagttgtttaaaccatttctggtagctaatgacaattttatattaaattgtatactaactttagtgagactgatttttttagttgtttacagtacaaatacttgtatttgttttttaattgcagtatttccaatgtcgcagtaatttagtaaaactctgtggctgccttgattttgacagattttgttaatataaactgattgttaggcaattagttatatttatgcataaatcaattgcactataattcatgaattatttattacaatattttctaatgaattcatgtatctgtcttgtgttgtaaatgtactgtaattctgttcctactttgtgttgttatatatctaaatctgattgtatgaattttaattgttcagttaacgtgtttctaggttgtaatttgtagtaaagcacttcaatgcttttgcacttaaatttacaacactgttggtgtgtgattgatttactcattcagtaaaagaaaaaaagaaaagaaaagaaaaaaactga

SEQ ID NO: 149030 - DNA, 5009 bp, Homo sapiens
  Payload ID: 9435
  Gene Symbol: LCORL
  Gene Name: ligand dependent nuclear receptor corepressor-like
  Uniprot ID: Q8N3X6
  ENST ID: ENST00000382226
  CDS Start-End: 110-1918
aacccccctccggggggcgcgcgctccggggctcgcgccgagggctcgcgcccctgcctcgtgcctgcgctgctcgtatgtaaatgagggcgcgtgacgcgggacgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaagactgtgaaccagaagagctgactgactggtctatggatgaaaaatgttcattttgtaacctacagagagaagcagtcagtgattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggggatggagtgttagatctctctacaaagaaaaccagcataaaatctgaagagtcatccatatgtgatccttcttctgaaaattcagtggctgggagactacacagaaacagagaggactatgtggaaagaagtgctgagtttgcagatggtttgctctcaaaagctttgaaagacattcagtctggagcactggacataaataaagcaggcatactttatggcatacctcaaaaaactttacttcttcacttagaagccttaccagcagggaagcctgcatcttttaaaaacaaaactcgagatttccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaaaaaatgaaagcctccaatatgaaacttcaaatcctactgtacagttaaaaattcctcagctacgagtaagttctgtctcaaaatcacaacctgatggttctggtctgttggatgttatgtatcaagtttccaaaacctcttcagtcctagaaggatcagctctccaaaaactgaaaaatatactccctaaacagaacaaaatagaatgttctgggcctgtaactcactcaagtgttgactcttactttctacatggggacctctctcctttgtgtcttaattctaaaaatggaacagttgatggaacctctgaaaatactgaagatggattagatcgaaaagacagtaagcagcccaggaaaaaacgtggccgctatcggcaatatgatcatgaaataatggaagaagctattgcaatggtaatgagcggaaaaatgagtgtttccaaagcacaaggaatttatggggtacctcacagcactttagaatacaaggtaaaagaaagatctggaacactgaagactcctccgaagaagaaactacgattaccagacactgggttatataatatgacagattcagggactggcagctgcaaaaacagcagcaagcctgtgtagattacttgttaggaaaatgtttgtgagtgtgtgtgtgtgtgtgtgtttgcgtgtgtgtgtatgtgcacaggtgtgtatttgtgtgtctatatacacacgtgggaattacaaatgctcactctgacaggagacatgaaattttacagttcaaaaaccacttacatgccttttgaaaaaaagttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccaggaatagaaaagaaaaccttaaaggatatgtataatgaaatttaatatttatcatttaatagttgatttagcaagaagttggggtttataaggtatatactttaaaaaaactgacacatagttaaccccagcagctatagaaccctttaatataataagatggagtactaagaacaaaaaataatttaaatttaattattaaaataatttagttttgtttttcatttgaaaaataagctaatgtgtaaggttagaaaagaaagttggaatgcaacttagagcatgtttataatgtgcacagaaaaagcttgagaatgataattttggtttaaatgtgctggttagttgatgttatgactactttaaattttaaggattgtgacacactcctactattgaaaaacctcagtgtaactttaatatatttgctgctgtgacatttcaaaacattttcagtttatcaaaatgaattgcagatttcattttggtgggcgatacattatcattttgctaataaccaaatttgcagtttgttcagggtcttgaatagatttacaaatatttaacactgaagctgttttgaactttcagtaatgtaaactctctactaattgggtagttagaagctgggcagtgcattttaacttttactagactcataagagagactggtcatttttacctagcagttttaaaatatgggtcaaagtatccttgttggatttatggagtatgcaactgtagtggtaaaatgttataaagcatatgccttcatataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctcttttttttttttttcaccccaagaaaatatacataatagattacagaacagcagatgtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcattttagtacttgtattatttatttttggtcagaaatagtaaattaaaatattttttgatagtttataggtaataatcaacccataacttttaaaagaaacaaaacatttctattattgagttaacatttgattatacaaactaggaaaggcagggaaattccccttctccccagtgattctattaagatgacctttatgttaaactttcaaagtactttatgaatttagttaccagttactatttattaattgacaattttctgaaaaatcccgtttcagcagacttaatgaaggtgaaagcaacccttatgtgctttctacttatttgaatgttcctcaagtattttatattaaaaaaaaaaagaaggaaaagagaaaacagtgcctctgtttttagaaaactactgctcagtaaagttgtttaaaccatttctggtagctaatgacaattttatattaaattgtatactaactttagtgagactgatttttttagttgtttacagtacaaatacttgtatttgttttttaattgcagtatttccaatgtcgcagtaatttagtaaaactctgtggctgccttgattttgacagattttgttaatataaactgattgttaggcaattagttatatttatgcataaatcaattgcactataattcatgaattatttattacaatattttctaatgaattcatgtatctgtcttgtgttgtaaatgtactgtaattctgttcctactttgtgttgttatatatctaaatctgattgtatgaattttaattgttcagttaacgtgtttctaggttgtaatttgtagtaaagcacttcaatgcttttgcacttaaatttacaacactgttggtgtgtgattgatttactcattcagt

SEQ ID NO: 149031 - DNA, 1013 bp, Homo sapiens
  Payload ID: 9435
  Gene Symbol: LCORL
  Gene Name: ligand dependent nuclear receptor corepressor-like
  ENST ID: ENST00000510451
  CDS Start-End: 7-246
acgcagatggacaagggaagagagagaatggccgctgccgccgccgctgctgccgccgccgccgccgccgctcagtgccggagccctcggtgcgcggcggagagaagaggattccggcgggaactcgactcttggcgccaccgcctcatgcactgtgtaggttttgagagtattttagaagggctttatggaccacggctacgaagagacctcagtttatttgaaggattgtataccatctcttgattcttcacagtcaacaccaacagaggagctatcatctcagggccagtccaacactgataagattgaatgccaagcagaaaattacctaaatgcactctttcgaaagaaagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaagcatgctacaagtgaaaactgatgagaaactgaatgtgtctgatgagaatacagcaagttgccctttgagccccattaagatgtgccttaatcgtcccattgaatggaatctgaatttgacaacagcatctctaacgagctgtacagttcataaccaaaatctcaaaagcgaagagaaatagattgcagttcttcttgcactatctttattttgtatgtcagtattccttctgaacaataagcatttatcaattgatcttgaagtatttctagtcctgtgatttgtctttatattaaatcattagcattaatcattttgattatattctttatatgttttttttacatgttttacatcagatcattgtggaattttgtaaacggattttgatgtttctcttttagt

SEQ ID NO: 149032 - DNA, 3475 bp, Homo sapiens
  Payload ID: 9436
  Gene Symbol: LRIF1
  Gene Name: ligand dependent nuclear receptor interacting factor 1
  Uniprot ID: Q5T3J3
  ENST ID: ENST00000369763
  CDS Start-End: 392-2701
agactgacgcagtcttcagcactgaccaggctctgttgggggtggtgccaccaaggccacgccccctgcgcctgctccggcggagtctggagagttgtcgtaggctctgagggcggagactcacgccgattctctctcagcgtagggctgtgagggcgcagtccaccgccaggagccttccggtttctgcgcggtgcgcgacctcgtcccgaagcctggggatacaccctctcgagagcccgctgtcgccctccgttaaggtcgaacccctcacagttgctgtgggcaactccagcccaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgtgtttcaggctgcatgtaccaagtagttcagacgattggctcggatggaaaaaatcttctgcaattacttccaattcctaagtcttctggaaatcttataccactagttcaatcttcagtcatgtctgatgctttgaaagggaatacaggaaaaccagttcaagttacttttcagactcagatttccagctcttccacaagtgcatcagttcaattgcccatttttcagccagccagttcttcaaactattttcttacaagaacagtagatacatcagaaaaaggtagagttacttctgtgggaactggaaatttttcttcatcagtttctaaagttcagagtcatggtgtgaaaattgatggactcaccatgcaaacatttgctgttcctccctcaacacaaaaagactcatcttttattgtagttaatacccagagtcttccagtgactgtgaagtctccagttttgccttctgggcatcatttacagattccagcccatgctgaagtgaaatctgtaccagcgtcatcattgcctccttcagtgcagcaaaagatacttgcaactgccaccaccagtacctcaggaatggttgaggcctcccaaatgccaaccgttatttatgtatctcctgtaaatacagtgaaaaatgtagttaccaagaactttcaaaacatttacccaaaacctgttacagaaatagcaaagccagtaatactaaataccacacaaattccaaagaatgttgctacagagacacaattgaaaggtggtcagcattctcaagctgctccagtgaaatggattttccaagataatctacagccttttacgccatctcttgttcctgttaagtcttcaaataatgtggcttcaaagattttaaaaacttttgtagataggaaaaatttgggagataatactataaatatgccaccattgagtaccatcgatcctagtgggacgcgatccaaaaatatgcctattaaagataatgctttggttatgtttaatgggaaagtctatctgttggctaaaaaggggacagatgttctgccatcacaaattgaccaacagaattctgtttctcctgatactccagtaagaaaagacacgttacagacagtgagttcaagtccagtcacagaaatatccagagaggttgtaaatattgttttggctaaaagtaaatcttcccagatggagacaaaatcactttccaatacccagcttgcttccatggccaatctaagggcagagaagaataaagtggagaaaccatctccttctaccacaaatccacatatgaaccaatccagtaactacttaaaacagagtaagactttattcacaaatccaatctttccagttggatttagtacaggacacaatgcccccagaaaagtaacagccgtcatttatgctagaaaaggaagtgtcctccagagcatagagaaaataagttcctctgttgatgcaacaactgttacttcacaacagtgtgttttcagagaccaagaaccaaagatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttgggactatgtacatacgttactgagattgtgtaaaaagtagatcctgaacagttatcacatttaatatttcttaaactgtaaaagtgtattttc

SEQ ID NO: 149033 - DNA, 1796 bp, Homo sapiens
  Payload ID: 9436
  Gene Symbol: LRIF1
  Gene Name: ligand dependent nuclear receptor interacting factor 1
  Uniprot ID: Q5T3J3
  ENST ID: ENST00000485275
  CDS Start-End: 358-1059
ggagactcacgccgattctctctcagcgtagggctgtgagggcgcagtccaccgccaggagccttccggtttctgcgcggtgcgcgacctcgtcccgaagcctggggatacaccctctcgagagcccgctgtcgccctccgttaaggtcgaacccctcacagttgctgtgggcaactccagcccaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttgggactatgtacatacgttactgagattgtgtaaaaagtagatcctgaacagttatc

SEQ ID NO: 149034 - DNA, 1912 bp, Homo sapiens
  Payload ID: 9436
  Gene Symbol: LRIF1
  Gene Name: ligand dependent nuclear receptor interacting factor 1
  Uniprot ID: Q5T3J3
  ENST ID: ENST00000494675
  CDS Start-End: 443-1144
gttttgcagtctttcactttaaaaactcaaaatggaaaattatatactttattttaatatttacaaatatttacaaatatttatttttaaataaaatgtatataccatgtagtatgttgtatttatttactcaatgttcttttaagtgtttcaggctgcatgtaccaagtagttcagacgattggctcggatggaaaaaatcttctgcaattacttccaattcctaagtcttctggaaatcttataccactagttcaatcttcagtcatgtctgatgctttgaaagggaatacaggaaaaccagttcaagttacttttcagactcagatttccagctcttccacaagtgcatcagttcaattgcccatttttcagccagccagttcttcaaactattttcttacaagaacagtagatacatcagaaaaagatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttgggactatgtacatacgttactgagattgtgtaaaaagtagatcctgaacagttatcacatttaatatttcttaaactgtaaaagtgt

SEQ ID NO: 149035 - DNA, 2953 bp, Homo sapiens
  Payload ID: 9437
  Gene Symbol: LNX1
  Gene Name: ligand of numb-protein X 1, E3 ubiquitin protein ligase
  Uniprot ID: Q8TBB1
  ENST ID: ENST00000263925
  CDS Start-End: 316-2502
tttcaatccctaaggtctcagcaatgctttatctgtcggggcttccgtgatgtcacccatttcctggtctggagcgaccaatgccgtcctccttcctccaggcacctgttcaccgaagttgaggctggtcacaactccggcggcccaaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaagctactggtgacctgcccattcagggagcactgcacccaggtgttgcagcgctgtgacctcgagcatcactttcaaaccagctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagtta

SEQ ID NO: 149036 - DNA, 3757 bp, Homo sapiens
  Payload ID: 9437
  Gene Symbol: LNX1
  Gene Name: ligand of numb-protein X 1, E3 ubiquitin protein ligase
  Uniprot ID: Q8TBB1
  ENST ID: ENST00000306888
  CDS Start-End: 253-2151
cagcctaagctctctcgccaaccgtggtggctccttgcgttcctacatcctctcatctgagaatcagagagcataatcttcttacgggcccgtgatttattaacgtggcttaatctgaaggttctcagtcaaattctttgtgatctactgattgtgggggcatggcaaggtttgcttaaaggagcttggctggtttgggcccttgtagctgacagaaggtggccagggagaaggcagcacactgctcggagaatgaaggcgcttctgttgctggtcttgccttggctcagtcctgctaactacattgacaatgtgggcaacctgcacttcctgtattcagaactctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaggagacatcattctaaaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaactaaaatgatttgtataccccactgaattcaagctgatttaaatttaaaatttggtatatgctgaagtctgccaagggtacattatggccatttttaatttacagctaaaatattttttaaaatgcattgctgagaaacgttgctttcatcaaacaagaataaatatttttcagaagttatagttgtcttttagtatgtgatactaattaagattacttttgtattatcactatttaaaagatcctagtaatttattctttcaaataccatgttatttgttaccatcaccgatgaatacctcctaggcttatccctaaaaatgctcgctcagagaattaattataaacttgttttgtttttagtaagaaatggctaaagctctttttttccacaatcgttagtaactgtataaaaactcatgctgctccaccagtgggccttggaaaatgcatcaagaaggccaaaccagcttgaccctggctcacagacatggtcatgaggcgatttaaatttgtgccacaatgaagagtgtgtgtacacatgcctcctagaaactacactatgggtaattaattaatttatttcatagaggccacccagatgccttataggttttattaatttggatatgaaagtgtaccccatttggtttcaccaggaacccaaatttagaatattgaaaagccatcaaaaagttgtgatatcaaaaatgtatgagtctcttaatatactaagcaagagtgtcacagcagtaatgataaagactagttttaatctcaagccttagaggggccctttgttgccttttgtgatgcagcctcttaagagagtggtgtttgattaacaaaaaaactgtggcccaagtggaacccttgaccttttctcagataatctgtgtatgtacacagctaacacagctctttagattccctgttaagtgactcattcacattcctttcttggatataaagtcattgctgtctttttatttttgaaatagtacaagacaaagatttttaacttaacatgaaaaattcactcttttattttggaaaaaaagttaacttttcatactaacaaacagaacaagatttaaggtaaatttcttaaacattatccagaaaaataacaagatttatagtatctacttctggtactaatatacacaaaaggccaaaaccatgcctattctgcaggtgtagcttcggtgctctcctgttcaggggcaggctcactgcccgcttcttttccttctttgcttcttttagattttttgtgtttgtgtctcctgtgactatctccttcttcactttcatggcgacgtctactattac

SEQ ID NO: 149037 - DNA, 731 bp, Homo sapiens
  Payload ID: 9437
  Gene Symbol: LNX1
  Gene Name: ligand of numb-protein X 1, E3 ubiquitin protein ligase
  ENST ID: ENST00000510143
  CDS Start-End: 433-731
aaggaagttcaggggcgtctcagccccatccaaaccagaagagatttgtcactgatgctaatgcatgctgctctgcaggggaccactctccctcgaagctccccatagctgctctcagttttatggatctgctctactcaaagccttgcagaaggggcaggggatgcccaggttaacccccgcacgtacaaaggtggagcagttttcatgcatagctgggacgaagaacactggaaagagaaagaaaaattttccgagctactgctaagccagaaaagctcagctctcaaacggactatctcctgagacgtcacacagctgggaactgatccgcaatacagcaaaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaa

SEQ ID NO: 149038 - DNA, 556 bp, Homo sapiens
  Payload ID: 9437
  Gene Symbol: LNX1
  Gene Name: ligand of numb-protein X 1, E3 ubiquitin protein ligase
  ENST ID: ENST00000504299
  CDS Start-End: 538-556
gcacattcaagtgtttccccagctgtgtttacagctttgggtttctaagcctcttgagaagtaatcagttttgatcatcttaaatcccaaagtaaattttcttttctggatattatcctagttgctaacacaggttagtctggcctattgaaccatcttttactgctgtgaccttcaaaaatgaaagctgtggttttgccctgagaagaagaaaaggagatttgaaatatgactcagattcttccctgcaaaaggctgggacccttgaaaactatctacgtggaaaagtgagagaacaaggggacacaagcaaagctgcccaggcacctgttcaccgaagttgaggctggtcacaactccggcggcccaaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctg

SEQ ID NO: 149039 - DNA, 603 bp, Homo sapiens
  Payload ID: 9437
  Gene Symbol: LNX1
  Gene Name: ligand of numb-protein X 1, E3 ubiquitin protein ligase
  ENST ID: ENST00000512247
  CDS Start-End: 332-603
acacggggctggacacgtgctgtgctcaggaaagaaagtaaattccacctggcaaattgctctaactgatttatttgtccacaaagagacgccacctacctgcttgcaggtattcaggcacctgttcaccgaagttgaggctggtcacaactccggcggcccaaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccag

SEQ ID NO: 149040 - DNA, 572 bp, Homo sapiens
  Payload ID: 9437
  Gene Symbol: LNX1
  Gene Name: ligand of numb-protein X 1, E3 ubiquitin protein ligase
  ENST ID: ENST00000507168
  CDS Start-End: 525-572
agaagagatttgtcactgatgctaatgcatgctgctctgcaggggaccactctccctcgaagctccccatagctgctctcagttttatggatctgctctactcaaagccttgcagaaggggcaggggatgcccaggttaacccccgcacgtacaaaggtggagcagttttcatgcatagctgggacgaagaacactggaaagagaaagaaaaattttccgagctactgctaagccagaaaagctcagctctcaaacggactatctcctgagacgtcacacagctgggaactgatccgcaatacagcaaaggcacctgttcaccgaagttgaggctggtcacaactccggcggcccaaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtg

SEQ ID NO: 149041 - DNA, 1024 bp, Homo sapiens
  Payload ID: 9437
  Gene Symbol: LNX1
  Gene Name: ligand of numb-protein X 1, E3 ubiquitin protein ligase
  ENST ID: ENST00000513421
  CDS Start-End: 648-1024
cgccatgtttctgaggcctccccagccatgtggaactcaggacactggggaaatagccgagttttgaagaatgtcagcagggagccaccagggatcatcctccccggtaagaagagacctccagagaccttcaggaagctggaaagaagcttccaatgattcccagtggtagaagtgtgtggtgcaaaggcacttaggtggacaggtttggccctcaacatgaacttgatgttgctaacacaggttagtctggcctattgaaccatcttttactgctgtgaccttcaaaaatgaaagctgtggttttgccctgagaagaagaaaaggagatttgaaatatgactcagattcttccctgcaaaaggctgggacccttgaaaactatctacgtggaaaagtgagagaacaaggggacacaagcaaagctgcccaggcacctgttcaccgaagttgaggctggtcacaactccggcggcccaaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaagctactggtgacctgcccattcagggagcactgcacccaggtgttgcagcgctgtgacctcgagcatcactttcaaac

SEQ ID NO: 149042 - DNA, 4627 bp, Homo sapiens
  Payload ID: 9438
  Gene Symbol: LNX2
  Gene Name: ligand of numb-protein X 2
  Uniprot ID: Q8N448
  ENST ID: ENST00000316334
  CDS Start-End: 131-2203
gtgcgcggcccgggcagccgcgctttcccaaaaaacacaccttgactttagtcagatacatcactgtctgttaaaggaaaccaagcgtgaagtggaagtctaacacatgaggatacagaattgattcaaaatgggaacaacaagtgatgagatggtgtctgtggaacagacctcctcctcttctctaaaccccctgtgttttgaatgtggccaacagcactggacaagagaaaaccatttgtacaattaccagaatgaagtggatgatgacctagtctgccatatttgccttcaacctctgctgcagccactagacacaccctgtggacatacattctgctacaagtgcctcagaaactttttacaagagaaagatttctgtccgttggaccggaaaagacttcattttaagttgtgcaagaagtctagtattctagttcataaactcctagacaaattattagttttatgtccattttcttcagtgtgcaaagatgtaatgcaacgttgtgatctggaggcacatctcaaaaacagatgtcctggagcttctcatcggagagttgccctggagagaaggaaaactagtagaactcaagcagagattgagaatgaaaatgggcccactctactagatcctgcaggtaccttatctccagaagcagactgtttggggacaggcgcagtgcctgtggagcggcacttgacatcagcgtctctttccacatggagtgaggagcctggccttgacaaccctgcctttgaggagagcgctggagctgacaccacacaacagccacttagtttaccagaaggagaaatcaccacgattgaaattcatcggtccaatccttacattcagttaggaatcagcattgtgggtggcaacgaaacacctttgattaacattgtcatccaggaggtctatcgggatggggtcattgccagagacgggagacttcttgctggagaccagattcttcaggtcaacaactacaatatcagcaatgtgtcccataactatgcccgagctgtcctttcccagccctgcaacacactgcatcttactgtgcttcgagagaggcgctttggcaaccgagcacacaaccattctgatagtaactctccacgagaagagattttccaagtggctcttcataaacgggactctggtgaacagcttggcattaaattggtgcgaaggacagatgagccaggggtttttattcttgacctgttggaaggggggttggctgcccaggacggcaggctaagcagcaatgaccgagtgctggccatcaatgggcacgacctgaagtatggaactccggagcttgctgcccagattattcaggccagtggagagagagtgaatttaacaattgctagaccagggaaaccccagcctggtaacaccattagagaagcaggaaatcatagcagcagcagccagcaccacacaccaccaccgtattatagcagaccaagctcacataaggatcttactcagtgtgttacatgccaagaaaaacacattactgtaaagaaggaaccacatgaatcccttggcatgaccgttgctgggggcaggggaagtaagagtggtgagctgcccatctttgtgaccagtgtgccaccccatggctgccttgcacgagatggcagaataaagagaggtgatgtgttgctaaatatcaacggcattgatttgaccaatttaagtcacagtgaggcagttgcaatgctgaaagccagtgccgcgtcccctgctgttgcccttaaagcacttgaggtccagattgttgaggaggcgactcagaacgcggaggagcagccgagtactttcagcgaaaatgagtatgatgccagttggtccccatcatgggtcatgtggcttgggcttcccagcacacttcatagctgccacgatatagttttacgaagaagttacttgggaagttggggctttagtatcgttggtggatatgaagagaaccacaccaatcagccttttttcattaaaactattgtcttgggaactcctgcttattatgatggaagattaaagtgtggtgacatgattgtggccgtaaatgggctgtcaaccgtgggcatgagccactctgcactagttcccatgttgaaggagcagaggaacaaagtcactctgaccgttatttgttggcctggcagccttgtatagattttggaaattggtttcaaatcttgcatcttccttttttagatttttgaaagaaaaccctttggtttcattgtgtttgtggtttaggagctgctgacactgctggtatacacagggccaaaacccactaagattgtccgtttatgtttatttaaatggtttcctaagttagttacatttcttttagcttggaaacagtcttccactaacctttgtgagtttatattttcagaattcagacttagttgttaaaatgttacctatggtaatgagcaaagctcacccaaactgtgccccagatggagtaaagaccttctggtgggtctttgttttcagtaactgaatcatagaacgagttctgtatccctcaggcctgatgtcagcaaagccagtaacaacagcgtgtactgccactgtcataaccaataccatgaatgaatatactttaaattttggtgataactgttccccatttttttttgaaccacagtctcactctcacccaggctggagtgcagtggcacaatctcagctcactgcaagctccgcctcctgggttcacgccattctcccacctcagcctcccgagtagctgggactacaggcgtgtgccaccatgcccagctaattttttgtacttttagtagagacggggtttcaccgtgttagccaggatggtctcgatctcctgaccttgtgatctgcccgcctcagcctcccaaagtgctgggattacaggtgtgagctgccgcacccggccgttcccattttttattggtgccaacatttcaaaacttcatactgtttataaactgattttctggtttatttctactgtaatctctcaatattcatagaagatgaagaaataagtctgacaacactaaagaaatttcttaatatactattattagaatagtagaggataaaagataatgttatccagttacaaaggaatttggatgataattataacttaatgttagagatggtaaagctgcacttacttgaacagcccaaaagcattaaaaatctatttccagaggaatgttttgctatgtagggaaattttgaagtagtttttgctaaaaaattatttctagagttgtgttattcttagcagtaatcttggctagaaatgtttttgtgatttatgcgattaaacgaaatgataaagataaaaccatattattaaatacctatatatcacagctaagtaggagaaagggagacctttttattttgttcaggtaggagtatttcttgtgtattttagaaacaattatttttcccattatttcttatgagattagttgtttcaagtaggagacagaaaagttctgttttgttggaaatgtaggttttagatgtatctttcagtcagctctcagtcactagactatttcatattttttgaaatgtttttgaaaattatgactagcccattttttgtcctttattcaacatacttatcctctgaacacataaataagtgaataagataaaaatatctttaccttattaatattatacatacttgaaaaaaatttcatttagaaacctagttcagaatctgagcaaatttacaagtgacctctgtaataaatggtattgataatcagagaatgtatttcagaatactacagtacaatatattatgaagcatgaccactttattttgaaacttagcaattgtattgctggggtttattgtatctgtagcatgtcactgattatttcagttagttttataatgatttttaaaaaacatatctatttggaataagatacagcaacaatcattgctactgacttgttcaaccccttagttacactgtatgatcaacatataacaagatacagtggaatggcccatacagtatattactgttgtgtgatgattggctttggaagcagtttgattttgaaatgctttgatattctaattgacatggaacaagttttttccctgctccccaaatagaattttgtaaccaactttgctatttttttaaagtttgtaagaatgtgtcatttcttggggagtagccatccatcaacaaatatcctgactgctactttgttatatacaaaatacttacattgaacctggtggcataatgagtattttgaaagaagaaatttcttcactctcatttttatagaaatcttggaatcagcttaagctgtagcttttatgacaaaagacagtcatttttggtcagagtgatatttggtgacggaaacttgttcataatttattgttactatagaactatttggattttctcatttttagttctgatagttaaatattttggtttgttctgtgccttcagtttaaattatttcaggatttttcagatgtttaaataatggtgtgaatcattcaggatggaaataaaagtcatcctttctgtaata

SEQ ID NO: 149043 - DNA, 3384 bp, Homo sapiens
  Payload ID: 9439
  Gene Symbol: LIG1
  Gene Name: ligase I, DNA, ATP-dependent
  Uniprot ID: P18858
  ENST ID: ENST00000263274
  CDS Start-End: 421-3180
ctcgcgggggcgcttccaccgattcctcctctttccctgccagtcactcctcagaccctcagccacacccgctcatccagggcgagggaaagcgcgggcattttcccagtgtgctctgcgggagggctcgccccacttcaccccttttcccgccctcctcccattcgggagactacgactcccagtgtcctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggatagcta

SEQ ID NO: 149044 - DNA, 3179 bp, Homo sapiens
  Payload ID: 9439
  Gene Symbol: LIG1
  Gene Name: ligase I, DNA, ATP-dependent
  ENST ID: ENST00000536218
  CDS Start-End: 421-2976
ctcgcgggggcgcttccaccgattcctcctctttccctgccagtcactcctcagaccctcagccacacccgctcatccagggcgagggaaagcgcgggcattttcccagtgtgctctgcgggagggctcgccccacttcaccccttttcccgccctcctcccattcgggagactacgactcccagtgtcctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggatagct

SEQ ID NO: 149045 - DNA, 3027 bp, Homo sapiens
  Payload ID: 9439
  Gene Symbol: LIG1
  Gene Name: ligase I, DNA, ATP-dependent
  Uniprot ID: P18858
  ENST ID: ENST00000427526
  CDS Start-End: 162-2828
agacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggat

SEQ ID NO: 149046 - DNA, 1527 bp, Homo sapiens
  Payload ID: 9439
  Gene Symbol: LIG1
  Gene Name: ligase I, DNA, ATP-dependent
  ENST ID: ENST00000542460
  CDS Start-End: 140-1387
tggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgccc

SEQ ID NO: 149047 - DNA, 575 bp, Homo sapiens
  Payload ID: 9439
  Gene Symbol: LIG1
  Gene Name: ligase I, DNA, ATP-dependent
  ENST ID: ENST00000593425
  CDS Start-End: 139-575
agaagaaggtaaatcgcgggcagcagcatcacctggaaggagtgggccctactggagggagatgggtggtgtcagggagaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacag

SEQ ID NO: 149048 - DNA, 4102 bp, Homo sapiens
  Payload ID: 9439
  Gene Symbol: LIG1
  Gene Name: ligase I, DNA, ATP-dependent
  ENST ID: ENST00000594759
  CDS Start-End: 144-2546
gccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctgatggcagaagcaggagggaaggagattagactcccgggggtatttcctattgcacaacccagaccgaggggtgctcacatccccctgtgaaggatccgttctccccagtttttatttactttttctggttctatgagcaactcttgcttcatatagaaaaacaggctgggatagaaagatgtcaggaatgtgtgtcagtgagagattgagattagctacaaatagtggtggctcacataagaaaagaatttttttgttatgaaatgagaagtgtggagggggcagtctgatgccattagggattcaggttcctcctctccccacatttttttttgtccccacattttttttttctgccatgtgcctctggcctcatcatcacaatgtggctgcaggagttccagccctcatggccatgcctgctccacgcaccagggaagagcaaagggggttggaccctgagtcagcctcagccagtgaacaccttctgctcaagttctgttgctcatcactttgctccatggctcacccctagctgcaaggaattctgggaaatgtaaagtgatttactttttttcaagttaaagtttttcttaaagctgtgcacattttggactagattttcttacgtatttcctatattcccctctccaacaaatttgggtcttttgccacagaaacagaacaaaatatcacctagaatcgtaccacccagagacacgcagtagtgacatttgagggaatgttttatttacatttttgcaaagttgtgatccttctctatgagtaattttcttttctgcctttttaccctggaagtactttgttttcagtgttgtatatgcccttaagcaatatggcaacaggacctgaatgcccgcacaagagttttcaagtgctgtgccccatagcacatagtgctgtgtcctgaaccagctccccgtggctgtgtggggaagttgttgccggctttgttctgatggcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggat

SEQ ID NO: 149049 - DNA, 3957 bp, Homo sapiens
  Payload ID: 9439
  Gene Symbol: LIG1
  Gene Name: ligase I, DNA, ATP-dependent
  Uniprot ID: P18858
  ENST ID: ENST00000601091
  CDS Start-End: 70-2475
gaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctgatggcagaagcaggagggaaggagattagactcccgggggtatttcctattgcacaacccagaccgaggggtgctcacatccccctgtgaaggatccgttctccccagtttttatttactttttctggttctatgagcaactcttgcttcatatagaaaaacaggctgggatagaaagatgtcaggaatgtgtgtcagtgagagattgagattagctacaaatagtggtggctcacataagaaaagaatttttttgttatgaaatgagaagtgtggagggggcagtctgatgccattagggattcaggttcctcctctccccacatttttttttgtccccacattttttttttctgccatgtgcctctggcctcatcatcacaatgtggctgcaggagttccagccctcatggccatgcctgctccacgcaccagggaagagcaaagggggttggaccctgagtcagcctcagccagtgaacaccttctgctcaagttctgttgctcatcactttgctccatggctcacccctagctgcaaggaattctgggaaatgtaaagtgatttactttttttcaagttaaagtttttcttaaagctgtgcacattttggactagattttcttacgtatttcctatattcccctctccaacaaatttgggtcttttgccacagaaacagaacaaaatatcacctagaatcgtaccacccagagacacgcagtagtgacatttgagggaatgttttatttacatttttgcaaagttgtgatccttctctatgagtaattttcttttctgcctttttaccctggaagtactttgttttcagtgttgtatatgcccttaagcaatatggcaacaggacctgaatgcccgcacaagagttttcaagtgctgtgccccatagcacatagtgctgtgtcctgaaccagctccccgtggctgtgtggggaagttgttgccggctttgttctgatggcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtg

SEQ ID NO: 149050 - DNA, 580 bp, Homo sapiens
  Payload ID: 9439
  Gene Symbol: LIG1
  Gene Name: ligase I, DNA, ATP-dependent
  ENST ID: ENST00000596549
  CDS Start-End: 132-580
acttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagaagcagagaccccgacggaaagcgtttcagagcctgaggtggccacgaagcaggaactgcaggaggaggaagagcagac

SEQ ID NO: 149051 - DNA, 377 bp, Homo sapiens
  Payload ID: 9439
  Gene Symbol: LIG1
  Gene Name: ligase I, DNA, ATP-dependent
  ENST ID: ENST00000598938
  CDS Start-End: 293-377
cggagggcggcgggtgcgccgaatgcttggggcctatgcttcgccatgtcggggtgtctgcagaggagtgggcgtggggacgctgaggctgccgagagcgcggtggagacggaagagcgcgggctgcgggccgccggagagtgcagagaggtgtctcccagagggaggggggccaggtagagggtagacgagagacagagacagttggacaggtcctctgagaagaggccttgaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagca

SEQ ID NO: 149052 - DNA, 792 bp, Homo sapiens
  Payload ID: 9439
  Gene Symbol: LIG1
  Gene Name: ligase I, DNA, ATP-dependent
  ENST ID: ENST00000596672
  CDS Start-End: 1-110
cgtggctggaggagcaaggcatgatcctgaagcagacgttctgggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggac

SEQ ID NO: 149053 - DNA, 3949 bp, Homo sapiens
  Payload ID: 9439
  Gene Symbol: LIG1
  Gene Name: ligase I, DNA, ATP-dependent
  Uniprot ID: P18858
  ENST ID: ENST00000613670
  CDS Start-End: 62-2467
ccaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctgatggcagaagcaggagggaaggagattagactcccgggggtatttcctattgcacaacccagaccgaggggtgctcacatccccctgtgaaggatccgttctccccagtttttatttactttttctggttctatgagcaactcttgcttcatatagaaaaacaggctgggatagaaagatgtcaggaatgtgtgtcagtgagagattgagattagctacaaatagtggtggctcacataagaaaagaatttttttgttatgaaatgagaagtgtggagggggcagtctgatgccattagggattcaggttcctcctctccccacatttttttttgtccccacattttttttttctgccatgtgcctctggcctcatcatcacaatgtggctgcaggagttccagccctcatggccatgcctgctccacgcaccagggaagagcaaagggggttggaccctgagtcagcctcagccagtgaacaccttctgctcaagttctgttgctcatcactttgctccatggctcacccctagctgcaaggaattctgggaaatgtaaagtgatttactttttttcaagttaaagtttttcttaaagctgtgcacattttggactagattttcttacgtatttcctatattcccctctccaacaaatttgggtcttttgccacagaaacagaacaaaatatcacctagaatcgtaccacccagagacacgcagtagtgacatttgagggaatgttttatttacatttttgcaaagttgtgatccttctctatgagtaattttcttttctgcctttttaccctggaagtactttgttttcagtgttgtatatgcccttaagcaatatggcaacaggacctgaatgcccgcacaagagttttcaagtgctgtgccccatagcacatagtgctgtgtcctgaaccagctccccgtggctgtgtggggaagttgttgccggctttgttctgatggcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtg

SEQ ID NO: 149054 - DNA, 3055 bp, Homo sapiens
  Payload ID: 9440
  Gene Symbol: LIG3
  Gene Name: ligase III, DNA, ATP-dependent
  Uniprot ID: P49916
  ENST ID: ENST00000262327
  CDS Start-End: 82-2931
caaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaagaggcggccagccagtgagcagagaggaagaactgtgccagcaggcaggagatagaacagcccggcctagccaggagagactgcagggactcactcagctgctggccccaagtcaaaatttacattaaagggaaaagaccagtctgggtgtgggaatgcagcattgagtttgtggtcag

SEQ ID NO: 149055 - DNA, 8400 bp, Homo sapiens
  Payload ID: 9440
  Gene Symbol: LIG3
  Gene Name: ligase III, DNA, ATP-dependent
  Uniprot ID: P49916
  ENST ID: ENST00000378526
  CDS Start-End: 134-3163
gcctgcgcgctgcctcccgctctaggacccggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactactggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttcttctctgtgttctcctattacatggtgaggatccccagtttgaagggaggggactagggtcaggtaggaaaatggggcctttatgaagaaaggggaggttatttgggccactcctctggagggatagagggctccaggaagatctgcatccccaaaacctggaaacaagactgttctttaagaataaaaatccacatggggcttgaggccaagaacagcccttgttgccaccaacatggagactttgtaccatatcccattcttagtgctcgagtgttccaacctgaagttgaagaagccaccctggctgcacatgccatcagccatgactgtgtatgctctggtggtggtgtcttacttcctcatgactggaggaataattatatgatattgttgaacccccaagtattggctgatgaacgtgggcatcagaggccagtagctttcttggcctacaaagtaaatggacagtatattatggaaggatttgcatccagcttcctgtttacaatgggaggtttaggtttcataatgctggaccagtcgaatgcaccaaatatcccaaaactcaatcgattttttttcttctattcattggattcgtctgtgtcctactgagttttttcatggctggagtattcatgtgaatgaaactgccgggctatctgatgggttagagcgcctttaagaagaaatcagtggatactggatttgctcctgtcaatgaagttctaaaggctgtaccaatcctccaatatgaaatgtgggaaagaatgaagagcagcagtaaaagaaatacctagcgaaaaaaacaggaagcatattgaagctcggactagaatttcttcttggtatcagagagacaagtttatcacagtatttttttttttcctgctgacctattgataataccaacaatgttgagtggcattttcttcttagtttttaatttcttaaagaaaatatactccatatctgcagggaaaaaaataaaaatccacacctgagaacagatccatacaacctgcttacaaagaacagctcctgtgctacctgaggctgatttatttgaagaacaaaaggaagagagacaatttagtgtagacaagtgctattcaatagaactttttgcagcagtggaaatatccataaatctgcagtatccaaccaaactagccacagacagctgctgagcaattgaaatgaagctggcacaactaaggaactgaagttcttattttaattcaacttcaaatggtcacatgtcactagtgactaccacactggacagtgcaggtgtagacggagttcagatcagactcctgaaacttaatggctctaaccttaggcaagttacgttaacatctaagcctcaatccctccaagtagaatgggtgcacctaaatcatagggttgtcctgttgtcctgagcaacattatgtaaagcacttagcccagagcctagcacatagttatctagagttgggaacgtcactcctggtgtgcatgtccagaccctacccgggagaagggcctaacctatgactttagaaccctcagttgcaggtgtgcatgttccagccaacactccactctgagtgcaggctcatcaggacaccatatggttgtaaactggctgccatgtcccaatccttccagctcttgagggtcagttctcaccttatgaacaaattaacaggctctggacctataagatcaaggaccactgcgccccctggccaccccaccgcccccccccaactttgatctgattgactttggcttccacctactgtttaaaatgtgtatgttgggggagtagggacagcacgggggaggggtttactttcctgactctagcccaggacatttggtgtttttgaataggcaccattcagccttgcttcagtattaggaataagatactttttattccatcctctatggagacaaaaagctgctcctcctttgagtactgacctacatagatttccatttctctcttcagcctcaggccaaacaaacaaccggacagggcagcagaacaaggctgtctcctcaggatcctgccaaaggcactgtcctctccaacctggacccagccccacttgcccttattggttgcttacacccagagtgcacactcacaggaaagggcctctgctggctgcaggtgatcatcttgtcccttctctgccttagtgtgtgttattgccatttcaatgtcagtggttttttatgtattttcttccagtctttgctgctgagatctgactgtatatactattttgtatcctttcatgtatttctttcatgtatttcaatgcagccctcaacatcatcatcataaatctctccagcagaatgctggaggcctccctcttctgaacctctacatgctgctggctggcatcaagcagaggtcatcactgggtgctgaacaggtcagctccctagggcaatgtgagcaaagtgttgtggctcatcctcgatcctttatgcccttttggcaagattcctttctcttctcagtcacagcagatggacacataatcttgttctcccaggggctgcattctcagtagtcttttccctgctccttgggcgcctggtcagggaggtttgtacaagcctgcgcacacacagcagtctgtcacgaggctgggccaaccttttttttttttttaaacagactcttgctctgtcattcaggctggagtgcagtggtgcaatctcagctcactgcaacctctgcttcccgggttcacaagcaattctcatgcctcagcctcccaagtggctaagacttaacaaacaggcacacaccatcactcgcagctaagtttttgtatttttagtagagaccacgtttcgccatgttgtccagactggtctcaaactcctggcctcgagtcatccacgcacctcagcctcccaaagtgctgggattacaggcgtgagccatggcgcccagcctgggccaaccttttctgagccatagtccagctgtactacagctgtatccaaaaggtaccatgtatctcccagggtaacctgaagacctaactgggcatactaactgtcctcagatttcagttctttaaggcccatctcttctagatcagtgtaaatatctgaactcacttggtgcttcaacccaattggtcttgggattcatcctttacctacccagctctcattctcttctaggttgttccatggcctcttccatatattacatttgtggtcttgagcaagttagttagttacaacaacactgagcatcttgaccaaggtcacttggcccaaccacaggctaatcccaggccatgtgcacatcccaggattagcttgtggtttatcagttgtcaatttttttttttttttaatacagggtctcactctgtcaccctggctggagtgcggtggcgatcagagctcactgcagcttcaatctcctggctcaagtgatcctcccacctcagccttccaagtagttgggactacccacatgcaccaccatgcacggctaattttttggtttttttgggttttttgtttgtgtttttttttgttttgttttttgagacagagtctcgctctttcgcccaggccggactgcagtggcgcaatcttggctcactgcaagctccgcctcccgggttcacaccattctcctgcctcagcctcccgagtagctgggactacaggcacccgccaccacgcctggctaattttttgtatttttagtagagacggggtttcaccgtgttagccagggtggtctcgatctcctgacctcgtgatctgcccgcctcagcctcccaaagtgctgggattacaggcgtgagccaccgcacccggcccttgtttgtttttttaagtagagacaaggtctcactacattgcccaggttggtctcaaactcctgagctcaagcagtcttcccaccttggcctcctaaagtgtggaaattatagcatgaaccactgtcaggctcttttgtcagtcctatcaacctctaacatcctcgcaccagacaggacaggtgtctgtattgaaactttattacaaaattataaagcagagctctgtaacaaaataatacacatttgggtttgctttaacctccaagtaagtctgagaaaatcttaataaaagccacttgaagtaacaattcacatccaagagatttccacaaatttatacaatgtatattgagcactagttcctgtacagcttattcttattagtttggatccaactattccaatgtattatgaaccagtcagctatctgtcttttgaaacaagtcttaactgaaatctcagagtaatcagcaaaagctacggaataattctaagaattagatgtttccatatcattaaaaccaaggatccatgaggggcagaagggaggattcaaagatttaaaaaaaatcaaattttagaccttggttaaatattaactggaatgggatcttggaactcccaactttaatttggtgtaataaaaatgatgcaaaaaaaaaaaaaatcagggttgtttgacaccttttttcctaaagggaaaccttcaccaaaaggggataaaagatttaaaggcaaaatgagtaaacaacctcagttttaattcttactgaggttactaaccagctatcagtatattattttcgattt

SEQ ID NO: 149056 - DNA, 235 bp, Homo sapiens
  Payload ID: 9440
  Gene Symbol: LIG3
  Gene Name: ligase III, DNA, ATP-dependent
  ENST ID: ENST00000585370
  CDS Start-End: 1-109
gaagtttcttcatgacaacatggttgaaattccaaaccggatcatgttctcagaaatgaagcgagtcacacatctctcttgtccctcagaaagctttggacttggctgacatgataacccgggtgatccaggagggattggaggggctggtgctgaaggatgtgaagggtacatatgagcctgggaagcggcactggctgaaagtgaagaaagactatttgaacgagggggccat

SEQ ID NO: 149057 - DNA, 592 bp, Homo sapiens
  Payload ID: 9440
  Gene Symbol: LIG3
  Gene Name: ligase III, DNA, ATP-dependent
  ENST ID: ENST00000588109
  CDS Start-End: 1-115
ggcccgggccaccacaaaaaaaatcgaggacctcacagagctggaaggctgggaagagctggaagataatgagaaggaacagataacccagcacattgcagagatcgttcactgaaggatattttatactcttttgggatcctacagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcag

SEQ ID NO: 149058 - DNA, 722 bp, Homo sapiens
  Payload ID: 9440
  Gene Symbol: LIG3
  Gene Name: ligase III, DNA, ATP-dependent
  ENST ID: ENST00000592690
  CDS Start-End: 101-722
gctgcccgcggcctgtaatgagcaagttccgaggcctacggtgagcgccggagccggagaggcagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcag

SEQ ID NO: 149059 - DNA, 887 bp, Homo sapiens
  Payload ID: 9440
  Gene Symbol: LIG3
  Gene Name: ligase III, DNA, ATP-dependent
  ENST ID: ENST00000585740
  CDS Start-End: 331-887
ctgcccgcggcctgtaatgagcaagttccgaggcctacggtgagcgccggagccggagaggcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaa

SEQ ID NO: 149060 - DNA, 1699 bp, Homo sapiens
  Payload ID: 9440
  Gene Symbol: LIG3
  Gene Name: ligase III, DNA, ATP-dependent
  ENST ID: ENST00000585941
  CDS Start-End: 64-1699
gctctaggacccggatttaaagagacaggcgctccaaccgtcgtgggctgcccgcggcctgtaatgagcaagttccgaggcctacgctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcaca

SEQ ID NO: 149061 - DNA, 4096 bp, Homo sapiens
  Payload ID: 9441
  Gene Symbol: LIG4
  Gene Name: ligase IV, DNA, ATP-dependent
  Uniprot ID: P49917
  ENST ID: ENST00000356922
  CDS Start-End: 274-3009
ccacagcgctgtagactgcgccgcattagaagcctggcctcctgatgctgtgctcttcatctagacccaagccccaggtcgtgggacgatttctcccgtttttgactccctggaactgtattgcctgctttacctgcgtacatgttgattctttctcatggcaaccccgcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactatt

SEQ ID NO: 149062 - DNA, 4065 bp, Homo sapiens
  Payload ID: 9441
  Gene Symbol: LIG4
  Gene Name: ligase IV, DNA, ATP-dependent
  Uniprot ID: P49917
  ENST ID: ENST00000405925
  CDS Start-End: 236-2971
gccagtgagcccccgcgacggtggcccggacggaaaagatacctcggcggcgtgggcccggctccctgctccaggacctagggatcttggccttccaccctcctccgagcaccaggactccctccagttccgtacccgaggcctccgtggtgaagaggtgccggacccgatgagctcgggagtccaccatcgctctgcaagccgcagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactattaaaataa

SEQ ID NO: 149063 - DNA, 3982 bp, Homo sapiens
  Payload ID: 9441
  Gene Symbol: LIG4
  Gene Name: ligase IV, DNA, ATP-dependent
  Uniprot ID: P49917
  ENST ID: ENST00000442234
  CDS Start-End: 153-2888
cttctggcgccagcttccggcttagcggctgagcttcaggcttgacgtcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactattaaaataa

SEQ ID NO: 149064 - DNA, 3884 bp, Homo sapiens
  Payload ID: 9441
  Gene Symbol: LIG4
  Gene Name: ligase IV, DNA, ATP-dependent
  ENST ID: ENST00000614526
  CDS Start-End: 263-2797
agcttccggcttagcggctgagcttcaggcttgacgtcaggaaaccatcaagatctcattttacagctgggattctctggttcacagaggtaacggagcttgcccgaggccagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactatt

SEQ ID NO: 149065 - DNA, 4180 bp, Homo sapiens
  Payload ID: 9441
  Gene Symbol: LIG4
  Gene Name: ligase IV, DNA, ATP-dependent
  Uniprot ID: P49917
  ENST ID: ENST00000611712
  CDS Start-End: 351-3086
tcttctggcgccagcttccggcttagcggctgagcttcaggcttgacgtcagcggcaggtgatgggagttgccgagtccacagcgctgtagactgcgccgcattagaagcctggcctcctgatgctgtgctcttcatctagacccaagccccaggtcgtgggacgatttctcccgtttttgactccctggaactgtattgcctgctttacctgcgtacatgttgattctttctcatggcaaccccgcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactattaaaataa

SEQ ID NO: 149066 - DNA, 4409 bp, Homo sapiens
  Payload ID: 9442
  Gene Symbol: LARGE
  Gene Name: like-glycosyltransferase
  Uniprot ID: O95461
  ENST ID: ENST00000354992
  CDS Start-End: 573-2843
cggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaagaacctacattaagaaacgcattcagatgcatcagccgtttgtaaagcacctgtcgtgagccagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgagacaatccacgttgctattgtctgcgccggatacaatgccagccgggatgtcgtcaccctggtcaaatccgtcctgttccatagacggaaccctctgcacttccaccttattgctgactccattgcggagcagatcctggccacgctcttccagacctggatggtgcccgctgtgcgtgtggacttctacaatgcagacgagctcaagtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaaggtcagcaagtcctgggcttggtggagaaccagagtgactggtaccttggaaacctgtggaaaaatcaccgcccatggccagcccttggaagaggctacaacacaggggtgatcctgttacttctggataagctgcggaagatgaaatgggagcagatgtggaggctgaccgcagagagggagctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcaggaagtctgtcatccagctcgatcttgccaacaccaagaaagcaatgattgtccccgcgttcgagacactgcgctaccggctgtccttccccaagtcaaaagcggagttgctgtcaatgctggacatggggaccctcttcacattcaggtaccacgtctggacgaaaggccacgcacccacaaacttcgccaagtggcggaccgccaccacgccttaccgggttgagtgggaggccgattttgagccgtatgttgttgtgagacgtgactgcccggagtacgaccggaggtttgtaggctttggctggaacaaagtggctcatatcatggagctggatgtgcaggagtatgagttcattgtgctgcccaacgcctacatgatccacatgcctcatgcccccagcttcgacattaccaagttccgttccaacaagcaataccgcatctgtctcaaaaccctcaaggaagagtttcagcaggacatgtcccgccgctacggctttgctgccctgaaatatctcacagccgagaacaacagctagcaccaagaagcccaccactagggggagacatgctgtaggggaagtgccactcgctgtttggggcccggccttcaaattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtttcttccccattcccctcccactcttgcaggaagctactgagacacaccttgacatagagagctaaattgcagtggataaacagcaacttcacactttctgttcccccattctatttttctcatcatttgaactttagccttttttttccccttttgcctgaagttagatcccactctgtctctaactcaaaccatcttcaagttttccattccgcatctttctc

SEQ ID NO: 149067 - DNA, 4138 bp, Homo sapiens
  Payload ID: 9442
  Gene Symbol: LARGE
  Gene Name: like-glycosyltransferase
  Uniprot ID: O95461
  ENST ID: ENST00000397394
  CDS Start-End: 517-2787
gggggcgcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgagacaatccacgttgctattgtctgcgccggatacaatgccagccgggatgtcgtcaccctggtcaaatccgtcctgttccatagacggaaccctctgcacttccaccttattgctgactccattgcggagcagatcctggccacgctcttccagacctggatggtgcccgctgtgcgtgtggacttctacaatgcagacgagctcaagtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaaggtcagcaagtcctgggcttggtggagaaccagagtgactggtaccttggaaacctgtggaaaaatcaccgcccatggccagcccttggaagaggctacaacacaggggtgatcctgttacttctggataagctgcggaagatgaaatgggagcagatgtggaggctgaccgcagagagggagctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcaggaagtctgtcatccagctcgatcttgccaacaccaagaaagcaatgattgtccccgcgttcgagacactgcgctaccggctgtccttccccaagtcaaaagcggagttgctgtcaatgctggacatggggaccctcttcacattcaggtaccacgtctggacgaaaggccacgcacccacaaacttcgccaagtggcggaccgccaccacgccttaccgggttgagtgggaggccgattttgagccgtatgttgttgtgagacgtgactgcccggagtacgaccggaggtttgtaggctttggctggaacaaagtggctcatatcatggagctggatgtgcaggagtatgagttcattgtgctgcccaacgcctacatgatccacatgcctcatgcccccagcttcgacattaccaagttccgttccaacaagcaataccgcatctgtctcaaaaccctcaaggaagagtttcagcaggacatgtcccgccgctacggctttgctgccctgaaatatctcacagccgagaacaacagctagcaccaagaagcccaccactagggggagacatgctgtaggggaagtgccactcgctgtttggggcccggccttcaaattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtttcttcccca

SEQ ID NO: 149068 - DNA, 3955 bp, Homo sapiens
  Payload ID: 9442
  Gene Symbol: LARGE
  Gene Name: like-glycosyltransferase
  Uniprot ID: O95461
  ENST ID: ENST00000402320
  CDS Start-End: 503-2617
gctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgagacaatccacgttgctattgtctgcgccggatacaatgccagccgggatgtcgtcaccctggtcaaatccgtcctgttccatagacggaaccctctgcacttccaccttattgctgactccattgcggagcagatcctggccacgctcttccagacctggatggtgcccgctgtgcgtgtggacttctacaatgcagacgagctcaagtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaaggtcagcaagtcctgggcttggtggagaaccagagtgactggtaccttggaaacctgtggaaaaatcaccgcccatggccagcccttggaagaggctacaacacaggggtgatcctgttacttctggataagctgcggaagatgaaatgggagcagatgtggaggctgaccgcagagagggagctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaagctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcaggaagtctgtcatccagctcgatcttgccaacaccaagaaagcaatgattgtccccgcgttcgagacactgcgctaccggctgtccttccccaagtcaaaagcggagttgctgtcaatgctggacatggggaccctcttcacattcaggtaccacgtctggacgaaaggccacgcacccacaaacttcgccaagtggcggaccgccaccacgccttaccgggttgagtgggaggccgattttgagccgtatgttgttgtgagacgtgactgcccggagtacgaccggaggtttgtaggctttggctggaacaaagtggctcatatcatggagctggatgtgcaggagtatgagttcattgtgctgcccaacgcctacatgatccacatgcctcatgcccccagcttcgacattaccaagttccgttccaacaagcaataccgcatctgtctcaaaaccctcaaggaagagtttcagcaggacatgtcccgccgctacggctttgctgccctgaaatatctcacagccgagaacaacagctagcaccaagaagcccaccactagggggagacatgctgtaggggaagtgccactcgctgtttggggcccggccttcaaattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagac

SEQ ID NO: 149069 - DNA, 562 bp, Homo sapiens
  Payload ID: 9442
  Gene Symbol: LARGE
  Gene Name: like-glycosyltransferase
  ENST ID: ENST00000434071
  CDS Start-End: 237-562
aagaatcttttccatttctgttgaatgagggggcttgagaaaaagctcacgaaattaaaaggagaatgaagacgcttctgaagggagctcgaacctacattaagaaacgcattcagatgcatcagccgtttgtaaagcacctgtcgtgagccagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactgg

SEQ ID NO: 149070 - DNA, 559 bp, Homo sapiens
  Payload ID: 9442
  Gene Symbol: LARGE
  Gene Name: like-glycosyltransferase
  ENST ID: ENST00000430220
  CDS Start-End: 152-559
agatttgacagtcaaggatcctcatggcagcatggagaggccaggcgtgtctgcgtggccattctgtggagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgag

SEQ ID NO: 149071 - DNA, 658 bp, Homo sapiens
  Payload ID: 9442
  Gene Symbol: LARGE
  Gene Name: like-glycosyltransferase
  ENST ID: ENST00000421768
  CDS Start-End: 98-658
atgaaaggcaaatgacttttcaaacattctgcagctgggatgacttctttttttaattttttaaaatatgtcaaggtgatttgtaatccacagcaaaatgttaatatggtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaaggtcagcaagtcctgggcttggtggagaaccagagtgactggtaccttggaaacctgtggaaaaatcaccgcccatggccagcccttggaagaggctacaacacaggggtgatcctgttacttctggataagctgcggaagatgaaatgggagcagatgtggaggctgaccgcagagagggagctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgg

SEQ ID NO: 149072 - DNA, 568 bp, Homo sapiens
  Payload ID: 9442
  Gene Symbol: LARGE
  Gene Name: like-glycosyltransferase
  ENST ID: ENST00000423375
  CDS Start-End: 426-568
aaataactccacagcatgtctcattaggccaggaacactccagctaatcgaggcgtgcctttgtcgtgcgctgctcgtgccaggggagttaaaaaaagaaataggcctgatcccaagggtgtgggcagggcagagataataaacccaaatacaaagtcaggccacccaggaatgaggtggtgtgctctatcggggccggattcccccagctccagatcatctggccaaatctgcaccctcctcccgggcctcccttttgctggggatggtttgggcagagaacctacattaagaaacgcattcagatgcatcagccgtttgtaaagcacctgtcgtgagccagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtccca

SEQ ID NO: 149073 - DNA, 560 bp, Homo sapiens
  Payload ID: 9442
  Gene Symbol: LARGE
  Gene Name: like-glycosyltransferase
  ENST ID: ENST00000432776
  CDS Start-End: 381-560
attcagaacagactagacaaataactccacagcatgtctcattaggccaggaacactccagctaatcgaggcgtgcctttgtcgtgcgctgctcgtgccaggggagttaaaaaaagaaataggcctgatcccaagggtgtgggcagggcagagataataaacccaaatacaaagtcaggccacccaggaatgaggtggtgtgctctatcggggccggattcccccagctccagatcatctggccaaatctgcaccctcctcccgggcctcccttttgctggggatggtttgggcagagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgg

SEQ ID NO: 149074 - DNA, 773 bp, Homo sapiens
  Payload ID: 9442
  Gene Symbol: LARGE
  Gene Name: like-glycosyltransferase
  ENST ID: ENST00000413114
  CDS Start-End: 367-773
ccccttgttttcagcgcgttctggaacagagctgcacgtcagaggaagaactgagcagccttcgagctaaaagacttggcattaaactttgacactttaatggtctctaggatattagatagtattttttcatataatgttcttctccgacacggtaatggcatcagaaacagaatctgctatgcctgccaacgtgcacggtgaggctcatcgccgcagagaacctacattaagaaacgcattcagatgcatcagccgtttgtaaagcacctgtcgtgagccagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcga

SEQ ID NO: 149075 - DNA, 1736 bp, Homo sapiens
  Payload ID: 9442
  Gene Symbol: LARGE
  Gene Name: like-glycosyltransferase
  ENST ID: ENST00000610186
  CDS Start-End: 1-978
ctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcaggaagtctgtcatccagctcgatcttgccaacaccaagaaagcaatgattgtccccgcgttcgagacactgcgctaccggctgtccttccccaagtcaaaagcggagttgctgtcaatgctggacatggggaccctcttcacattcagctttgattttagccagaccctatctcccatcatcagctgcaagacgacagttccaaacacatgcctataattgtcctcggcgttggcttccttctcgaggacttgggtactgttcttcatgagccctaattttacagcatgttggaacggctcaacgttgaagccaaagtggtacgtgccaggtgaacatcctcacggtaagattgaagtggtacatgccaggtgaacatcatccccgtggtaagattgaagtagtacatggcaggtgaacatccctgtggaaagattgaagtggtacatgccaggtgaacatccccgtggtaacattgaagtggtacatgccaggtgaacatccccgtggtaagattgaagtggtaggtgcagatgaacatccccgtggtaagattaaggtggtacgtgccaggtgaacatccctgtggtaagattgaggtggtacatgcaggggaacatccccttggtaagattgaagtggcctgatgattacgcaacacttccttgaagacaacgggctgggaggggcctgggatgggatccctcagcttcactgcaaaggcagacttgagtggggaaggacttctcaatgtctcctggagttccaggtggccctaggtatcctggatggcgtgggagtcttaaacaccaacgtaaacagaaaggggatatttgaaattcatgcatttcacagtttattaatttctttccattttaaccctccttactaacattcatttacccttcaagaatcatcataagcatcattttcccaggaagtcctttcctctatgccatcagaatagcaaaatctag

SEQ ID NO: 149076 - DNA, 581 bp, Homo sapiens
  Payload ID: 9442
  Gene Symbol: LARGE
  Gene Name: like-glycosyltransferase
  ENST ID: ENST00000609799
  CDS Start-End: 1-552
ctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacagctttgattttagccagaccctatctcccatcatcagctgcaagacgacagttccaaacacatgcctataattgtcctcggcgttggcttccttctcgag

SEQ ID NO: 149077 - DNA, 5368 bp, Homo sapiens
  Payload ID: 9442
  Gene Symbol: LARGE
  Gene Name: like-glycosyltransferase
  ENST ID: ENST00000608642
  CDS Start-End: 1-831
ctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcagctttgattttagccagaccctatctcccatcatcagctgcaagacgacagttccaaacacatgcctataattgtcctcggcgttggcttccttctcgaggacttgggtactgttcttcatgagccctaattttacagcatgttggaacggctcaacgttgaagccaaagtggtacgtgccaggtgaacatcctcacggtaagattgaagtggtacatgccaggtgaacatcatccccgtggtaagattgaagtagtacatggcaggtgaacatccctgtggaaagattgaagtggtacatgccaggtgaacatccccgtggtaacattgaagtggtacatgccaggtgaacatccccgtggtaagattgaagtggtaggtgcagatgaacatccccgtggtaagattaaggtggtacgtgccaggtgaacatccctgtggtaagattgaggtggtacatgcaggggaacatccccttggtaagattgaagtggcctgatgattacgcaacacttccttgaagacaacgggctgggaggggcctgggatgggatccctcagcttcactgcaaaggcagacttgagtggggaaggacttctcaatgtctcctggagttccaggtggccctaggtatcctggatggcgtgggagtcttaaacaccaacgtaaacagaaaggggatatttgaaattcatgcatttcacagtttattaatttctttccattttaaccctccttactaacattcatttacccttcaagaatcatcataagcatcattttcccaggaagtcctttcctctatgccatcagaatagcaaaatctagtgtttactctggccacagcgtttaccacactgaataataatctctcctctatgtacctgttttgtttccttaaacaggccatagcaggtattttacttgattttgttcctgaagtgctaccatacagtgtccagcatagagttggtactcttggtgtttttctgaagcaatgatggaataaatagttgcttagattttcaaattcatctcatatatttgatcatatgattttattatcacaaacagcagttaaggactcgaaggaaacattgacccagggaagtccagggattgtatcatatcagagataaaagggatgttagagtgatgttttcccagctgggctgtgtgatacaatcagctgtagagcctgtgaataacccagtgtcctcgctaataatgctgtgaccttctaaatcagaattttgggggtttggatctaaacctgcatattagtaaaggtccctagatgattttgaagtacaggtagatttaaaaatcacagatgaggaatcaaactggtgagtggcttcccgtgaggttcaaatggcacagcattttctcagaacctatgggagatctcctaatactgtatccaaggttgttgttggtgacaccaaactgcagcaaatccctggacttgcagcaaactcaccagtgctccagtgttaacaatgggtgagcacagagcaactatgccactttaaagagcacaccaattttaatgctatctcaactatcatcaaggtttttccttaatcatataaacatcaaattgtggcttcttcaggatctatccccgaagttcttctggggtaaaatcaaagcatctattctttttataatttaaacttttattttagattcagtggtacacatgcagatttgttacatgggtttattgcacgatgctgaggtttgggatacgattggtcccgtcactcaggtagtgagcatagtatccatagttagtttttccaccctcccttcctcctgcctctagtagtccccgttgtctatagttgccatctttttgtccatgagtacccagtgtttagctcccacttgtaaatgagaatgtgcggtatttggttttctgttcctcagcatatgttttaaggacctatgtgcttacctgtgcttgggatgagagttcgtggtaattttttttttttaattcttgtcttggccgagcgcagtggctcacacctgtaataccagcactttgggaggccatggcaggtggatcatctgaggtcaggagtttgagacaagcctgaccaacatgtgaaaccctgtctctatttaaaaatacgaaaattagccaggtgtggtgttgtgtgcctgtaatcccagctacttgggaggctgaggcagaagaatcacttgaacctgggaggcagaggttgcagtgagctgagatcgcgccactgcactccagcctgggtgacagagcgagactctgtctcaaaaataaaaatatacataaaaataaaaaaaaaaaacaaaatcttacgttgattattactgcttgtcagaaacacctgtatattttcactggtttatggatatttcaatagaagaaaaacaagaaaagaaataaccaataacatctgaatgttttattttctcacctggagtgccgctcatccctggaagacgtacttgggaacttcgagctcctgggaatctatgagaattgcagaaccttgacatttctgaagagttgacatcagctcccactgataaaacagacaaagcgaaaagtcagacatcgacagcaggagatcaatggataaaaacggacataaactgcaagatgtttctgctcctcgtgagggattatgttcccagcactgttagggggcagcaaactcacaatcccaagaaataagtttgagtttggtcatatccatgctctcctcctacctcccttcttaatggggcacaaacagggagaaaggcgacctatagctacctggtatttgatgttaatattgtttgctgaaacttgaacttctgctgacgtagaggttttctcaaggacactcaagcctttgactctttaagtaaatatattaagtggtgctatctttgttatgatttggcactgatagcccacacaattaagcatggaatttcctcaaaaacaagccaattgggagtttcatttactattcaccacttgctaaatgtttccctcatatctgcatcgtaaatttctttttattcttacagaatagctagagatcaccagtttaagaaatcctacaagactttttccatgagagctatgcactctctctccagcatcacctctccatctgcttttcacgatgcatttcttacactggaatgtgataaaaccgtacactgtacttagcccttccctgtaaaggggcaatgagctgtttaagggtaaaggggtagttactaagcccatgccatcgtctgtattaagtcttatttttgtatttctacaagggtggaaagagagcctgttaagtgaatgtacctgtaatgaacaagttcatgccaaacagtggagtagctttcaattattttggagccaaagaccttcacttcattctggagtattgaaacacaaagatggtcattggaaatgttggaaactggtttttttcctacatcagtaaaagcataccacacttcattttaaaatgtaatacagagttatagaaaatatattcaaggcccaagtgacaaattggtaaatagcgaaaagaatcagagcttgaacaatttacttagttcttctgagcacacttttccaacctgcgacatggggacaatgagggctgcccaagacgactgtgttaaggatctgtgataatttatatgatgcatctagtacagtgttggacttaaaagaaactcataatatttgagaatatatgcaaatgctggattttcatggaatgacagacacccctttactcacattgattaagcagtgcaattacaacatagacatgagaagagaatctgagaagacacctctatttgtgggtaccggcatgagcaaacactaaaggaaattttcccagaggactgtaatccacctccaacactaatgaaagaactttgtaagcatacacgtccaagtgttaaccttttaattggtgacaatctccttattatgaaagttttaagaggtacttagtgtgccataacattttgtcataagtgtataattcagtaactttcagtcaattgttagagctgtgcaaccactgccacaattcaattttagaatatttccatcaccccgaaaaggcttcatgtgccaatttacagacatcctctattttcaccccaacctccaggcagccattctttcttctgtagataagcaagccatcagtaacttccttgccagcaaagttgatcctgatttatgatttttctgatactttaagtaaagagaaagaaaagtcatagggaagatgatatagtttggctatgttctcacccagatctcatcttgaattgtagttcccatcatccccacgtgtcaggggagggacctggtgggaggtaattgaatcactggggcagttacccccgtgctgttctgtgatagtgactgagttctcatgagatctgatggtgtgataaggggcttttcctcctttgttcagcacttttctctcctgctgccctgtgaagaggtgccttccaccataattgtaaatttcctgaggccttgcctgccatgctgaactgtgagtcaattaaacctcttttctttataaatc

SEQ ID NO: 149078 - DNA, 6165 bp, Homo sapiens
  Payload ID: 9443
  Gene Symbol: LIMCH1
  Gene Name: LIM and calponin homology domains 1
  Uniprot ID: Q9UPQ0
  ENST ID: ENST00000313860
  CDS Start-End: 55-3306
cgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacacctcagtttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaa

SEQ ID NO: 149079 - DNA, 5705 bp, Homo sapiens
  Payload ID: 9443
  Gene Symbol: LIMCH1
  Gene Name: LIM and calponin homology domains 1
  Uniprot ID: Q9UPQ0
  ENST ID: ENST00000381753
  CDS Start-End: 174-2846
agagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatcaa

SEQ ID NO: 149080 - DNA, 5740 bp, Homo sapiens
  Payload ID: 9443
  Gene Symbol: LIMCH1
  Gene Name: LIM and calponin homology domains 1
  Uniprot ID: Q9UPQ0
  ENST ID: ENST00000396595
  CDS Start-End: 174-2882
agagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaattgttttgaaaatgtacagatcaagtccaatattttgattatccacctgcatgttttattaaatattttgataatgtggatgtttacactttgcatgatattagcagagtaccactagtaatgcacaaacatgtacaatatggtcattcataaccgatttttatagaatactttttacatgtgcaactccatccgttatgtaaggattacatgaatattgcacattcccttctggtttcacaaacccatttatacatatttcttagtgaggctcattgtacatgtattgaagctagaatcgagtcaagaaaaataaagccccattctccaactgcaaaatgtgctttcccataatgaacactagtcaccagcacagaataatctccaacattttctaaattctaattgccaactgtttctatttatatttgatttatatttcatttggagtctgttacatggcagcttaggcagactagatcttgttttttccaatgcagcataatgagtatgatctatttcttttcaaataatctttgagatcccaggaaaaaaaaaatgctctgctccattgagctataatgtaaatgtgtttgtttaaaaaacaggtgaggcaagtgagtgatttattgttcctgaggaagtatatctgattttttttctcatactccaaaagctagtccctactctttaataaaaataatgggtaactttttgtttttcactagcgaacttccatgacatttcctttctatgtagtgtgattaatgcaatacatattatagttatctatacacagtgtaagatttaacaaactgaaatgatccacctcatatgtgagtccgtccaaaagatgttactgctctgggtgggccagtgttctatatcggttatactaactttcatttaaagtatttattctaaaatgcctctgagaaacagtaaaaaataaaaacaacaagttgtctaaaatgcaacagcttttatagtaaatgtacatttataaataaaatactcaaatca

SEQ ID NO: 149081 - DNA, 789 bp, Homo sapiens
  Payload ID: 9443
  Gene Symbol: LIMCH1
  Gene Name: LIM and calponin homology domains 1
  ENST ID: ENST00000446625
  CDS Start-End: 410-789
acttcaacactgaaggagtgctactaggcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaa

SEQ ID NO: 149082 - DNA, 3439 bp, Homo sapiens
  Payload ID: 9443
  Gene Symbol: LIMCH1
  Gene Name: LIM and calponin homology domains 1
  Uniprot ID: Q9UPQ0
  ENST ID: ENST00000511496
  CDS Start-End: 387-3080
agcctgcttgtggacagagcaggggttggcagtggtgacgactgttttgggaaaggaaatgtaagggcatttcggctgctgtgctggggctgacgaggagcacacaggagagatgcccctcccatctcccagagtgggttggctggagttcattgcggagcatgaggacgtgtgggggacaatattatcttattcttgagaggttgtaaagagctcggccttaaagaatctcaactttttgacccgagtgacctccaggatacatccaacagagtaacagtcaagtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaa

SEQ ID NO: 149083 - DNA, 3051 bp, Homo sapiens
  Payload ID: 9443
  Gene Symbol: LIMCH1
  Gene Name: LIM and calponin homology domains 1
  ENST ID: ENST00000508466
  CDS Start-End: 1-2753
acattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaa

SEQ ID NO: 149084 - DNA, 3474 bp, Homo sapiens
  Payload ID: 9443
  Gene Symbol: LIMCH1
  Gene Name: LIM and calponin homology domains 1
  ENST ID: ENST00000509277
  CDS Start-End: 367-3117
attgttctccctgctctgaacatgtgggtcagccacaagtgctttcagctcccccagcgccaagagctggctgagagcgagagcatgcctggattcttctgaggcatcaggaaaagcgttttgcatatttttcattgcctttctttttttttttttttttttaacttttgcctcagaaagacagctccctttcagagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttag

SEQ ID NO: 149085 - DNA, 1506 bp, Homo sapiens
  Payload ID: 9443
  Gene Symbol: LIMCH1
  Gene Name: LIM and calponin homology domains 1
  ENST ID: ENST00000509454
  CDS Start-End: 174-656
agagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggttaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggtaaggcctgagcaccgctgccctcttcctggcttgggcatgagtggtttgggaactgcagctcctggacaggaacgaggttaaatgaccaattcagaactttgatggaagattacagatggaggtgggtgggacagatctttggagagagcttgtcaggagaaaatagaagcttcgtgagtgcgcctagaacagtgcctggcacacagtaggtattcagcaactacttgtctaaataagcagatttctgaaaccaattctgttgataggacattgagagcaaatctgtcatccttgtccttctgcggagactgcttgactcccaatcctgtcagattaggcgtagaaagattcctatctttatgcaaaaagatgttttaaaactctaggcttaaattaacttgatataagctcaaatatgtgatgcatggaatgtggttcacaataacatatagaaatagtcataataaatggatttctcatctctttagagaaacagtgttttaatctctgattatgcttttgtatttatttattcatttattcagcaagtacttattgagcatctactatatgctaggcattggggacccaataacaaataaggcagagtccctgccttcaagaatcttacaataaaataaacttgtctaatagtccatctgtactattattttccattgaataaagatgttattacaatttttaatttgctgaacaaactaatgaaatttacctttccagcagaaaaggtttttgcctttcattatcaagtctgggataactctcaatgttgcgggtatgatgcattgtatgaattaaatggctgcgttgaattttcttcacattatcag

SEQ ID NO: 149086 - DNA, 5071 bp, Homo sapiens
  Payload ID: 9443
  Gene Symbol: LIMCH1
  Gene Name: LIM and calponin homology domains 1
  Uniprot ID: Q9UPQ0
  ENST ID: ENST00000512820
  CDS Start-End: 27-3236
gcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagagtcgcctggcactgccagtgttccgcttagagttcagaactcttggcgacgatcccagtttttctcccagtcagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaaaagaaaaa

SEQ ID NO: 149087 - DNA, 5057 bp, Homo sapiens
  Payload ID: 9443
  Gene Symbol: LIMCH1
  Gene Name: LIM and calponin homology domains 1
  Uniprot ID: Q9UPQ0
  ENST ID: ENST00000512946
  CDS Start-End: 57-3230
ggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacacctcagtttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaa

SEQ ID NO: 149088 - DNA, 5054 bp, Homo sapiens
  Payload ID: 9443
  Gene Symbol: LIMCH1
  Gene Name: LIM and calponin homology domains 1
  Uniprot ID: Q9UPQ0
  ENST ID: ENST00000508501
  CDS Start-End: 57-3227
ggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaaaaaattaaa

SEQ ID NO: 149089 - DNA, 5129 bp, Homo sapiens
  Payload ID: 9443
  Gene Symbol: LIMCH1
  Gene Name: LIM and calponin homology domains 1
  Uniprot ID: Q9UPQ0
  ENST ID: ENST00000513024
  CDS Start-End: 579-3311
ggatcgggagaccattatgggatggggaagcctttaccatacctaggcctgggaggttgagtgggacaagaggagatgaggaaccttctggaaaccccctaaccacctgcaggaagggacgagataaataaatgcacgtctctcttcagctcactgaccatctgcctacctcccgttaatggaaccgcgactcacagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagagtcgcctggcactgccagtgttccgcttagagttcagaactcttggcgacgatcccagtttttctcccagtcagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaagaa

SEQ ID NO: 149090 - DNA, 5467 bp, Homo sapiens
  Payload ID: 9443
  Gene Symbol: LIMCH1
  Gene Name: LIM and calponin homology domains 1
  ENST ID: ENST00000503057
  CDS Start-End: 435-4838
agcatttcagccgcagcagcctgcttgtggacagagcaggggttggcagtggtgacgactgttttgggaaaggaaatgtaagggcatttcggctgctgtgctggggctgacgaggagcacacaggagagatgcccctcccatctcccagagtgggttggctggagttcattgcggagcatgaggacgtgtgggggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagctttcctgaaacgatagaggaagaggggagtgaagtggggtctgctggtgaagacaacccagctggccaaatgaatcctggttggaagccttccgatggtgggtgtgaattacctgacggcagtggtaaggagcacccttcttcagacggggctgtggtggcaccagctcccaagtctgaagaaaaagatgctgctgagatccaaaagcgcaaaaggctagagcaagctggaatcaaggtcatgccagcagcacagcgctttgccagtcaaaaacaattaagtgaagagaaagaagctattcgtgatattgtccttcgcaaagaaaactctttcctgacccaccaacatggcaacgattcagaggcagaaggtgaagttgtgtgtcgactgcctgatcttgagaaggatgactttgctgcaaggagagcaaggatgaaccaaaccaagccaatggtgccattaaatcaactcctctatggcccttatccaaagaaaggggcagagaaatcagatggcagcaaacagctctcaaagggaatctcaaaaaaaagaagtctagaatataaaagaaaccagggccacacagaagaggtgaagttgatagtgacctgtaacatgagggctcaggaaagtgaacctgtggaaggaggactcaggaaggtgccagatcttcacaaggatgacctggcccagcagagaattcagggcagccttgcccctcaccgcgagcccccgagcttcattacgctctccaacataacagaagctgacttggagacgtgggagagactcaaagtgtcagaaaaggcgagggatggagatgttcagcacatctgtgcttctgagccttccccagaaattaaagcagaaactgccattcgtgatgactttgccaaccgcaaagcaagggcctctaagaaagcttccagccccaggcaaaagtttgtgcactttgggccagtgacggagctagatcagcagaaatggaagcggcttagcattggcaaggctgggcctagagaggatgaagaagaagtcatctgtcatggcagcaagattcaaatggactctgtgtctcctgtctcagcggccacttccagcttaaagggccaccaaatatttaatcgacaaaatgactgcagaacaatgaattgtggccgaggtgactattgcagaagggcctcgtggctggctcctgtgccggagtctcaggaagagtgggtctgcagtttgggcgagtgcccgagggggacagaggaagttacatccaaacagctgccacaggatggcaaagaagaaacagaaagcgctccaagagattctgagaggctgtcaaaggcagaaagatcagaggacagcagccagccactggtgtgtcctctggcctctgagtgtgaggcttcagggacagaagagaagttggagaagatgacagctcctgcctggagtggcagtggactgaaaggccagcgaaagttggatgattcacgaaaagatgacatgatggccaggagaactgggatgtcccttagacacactggatccaacccaaaccagttccttccagttccatttgcaaagcaacaggatgtggaagaatcttctaaaggtctacccatgaaagatcagagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagaaaagtccccgagagcacttccaggctgggcctttctctccctgttctcccacccctcccggtcagtcaccaaacaggtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtatta

SEQ ID NO: 149091 - DNA, 3543 bp, Homo sapiens
  Payload ID: 9443
  Gene Symbol: LIMCH1
  Gene Name: LIM and calponin homology domains 1
  ENST ID: ENST00000514096
  CDS Start-End: 221-2914
tttatttttcctttctattgggaatgcagaggggactttcgcgagcatcccagggaatctgcagtgtggcattccagtctttgcggatgagaacatgcctctctgccagtgttatccacagtcctaattttaagcgacagtctggatgatattaaattgaggtttatctttgagtgaccagagttatttttgttttagtcagcctggactattgtaattaatgctaagacactggcgggaacaaggcttttattataatacgagggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttatgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtatta

SEQ ID NO: 149092 - DNA, 551 bp, Homo sapiens
  Payload ID: 9443
  Gene Symbol: LIMCH1
  Gene Name: LIM and calponin homology domains 1
  ENST ID: ENST00000511424
  CDS Start-End: 474-551
aaaaaggtggcgtatatattgacactactaaaacagatctgccaaagagcctgttgaatttttctttgtaatgcaactttttggagccaactcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattcc

SEQ ID NO: 149093 - DNA, 4792 bp, Homo sapiens
  Payload ID: 9443
  Gene Symbol: LIMCH1
  Gene Name: LIM and calponin homology domains 1
  ENST ID: ENST00000512632
  CDS Start-End: 35-2977
atcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagctgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaagaaaaaaa

SEQ ID NO: 149094 - DNA, 1570 bp, Homo sapiens
  Payload ID: 9443
  Gene Symbol: LIMCH1
  Gene Name: LIM and calponin homology domains 1
  ENST ID: ENST00000509638
  CDS Start-End: 617-1078
acggcgcgttggagcccgggcggcgccgggaacagctgccgcggcgtcctctagcagcgcgcggctctcccgggacctgcgccggccgggggcggggagaggcggggaggggaggccggcgggcgggaaggggcggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgaggttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacagagtaacagtcaagagccttgattatagtaggaagctgaaaaatgtattagttaccatttactggctgggaaaagcagcaaacagctgcacatcctacagcggaacgacactaaacctgaaggagtttgaaggattgttggctcagatgcgaaaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggtaaggcctgagcaccgctgccctcttcctggcttgggcatgagtggtttgggaactgcagctcctggacaggaacgaggttaaatgaccaattcagaactttgatggaagattacagatggaggtgggtgggacagatctttggagagagcttgtcaggagaaaatagaagcttcgtgagtgcgcctagaacagtgcctggcacacagtaggtattcagcaactacttgtctaaataagcagatttctgaaaccaattctgttgataggacattgagagcaaatctgtcatccttgtccttctgcggagactgcttgactcccaatcctgtcagattaggcgtagaaagattcctatctttatgcaaaaagatgttttaaaactctaggcttaaattaacttgatataagctcaaatatgtgatgcatggaatgtggttcacaataacatatagaaatagtcataataaatggatttctcatctctttagagaaa

SEQ ID NO: 149095 - DNA, 8405 bp, Homo sapiens
  Payload ID: 9444
  Gene Symbol: LMCD1
  Gene Name: LIM and cysteine-rich domains 1
  Uniprot ID: Q9NZU5
  ENST ID: ENST00000157600
  CDS Start-End: 233-1330
ggacagcctcgcgctgggattggctggcctcgcgcgagcgccggcgcggagtggctggcgaggttttagagggagtcccgctctccaattaaagcggcccagctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccacatacacccttatctaattatttacaccatggcagtgattttgcaacacccagtgctggcagaaaatatagtaaaatactaatgagcctctctatcaatgtatctcatcagacttccactgggagtgtaggctttgggacagaacccccgccccacctgcctattccagatactcccagatcactaatgtaacaaaggtatcatgttttatggtacactgaaaagtggcctgctgggaactgatgagcttctctttagccagggacctgactcagctgccctcagagcccaggaaaatagcgaatgaacccctctgggaataagaccagtactgggaaaccactgaacaggggccacctaagctccaccaatgggtgccacatgggatgtggtgactaatgtgggcagatctttaaaaatacagcactttttcaaatgccaaaacaatcagaaacaaaattttttcaataaaaattaatctaaaatttaacaatgccacttttatgagaaatctcaatttttaatgttgccaactaaacattgaatgagtcacgtagaataggtctttgggccaaattgtatctccattttatggtctctctgaacattttcagctcttaaattaatttctttcccacagtttctaagaaaaacatatttttctactgggagtataaggatgaaaaagacacaagtcctaggagcttacggtctggtcgccagtggttttctttcttgaacttcctcatctgctgccagttttctttaacctcaccatccaaatttcactctgaccatctcgtacctagaaaacccccattcatgtgctttataagtttcaccaaagccattgctatatcctcccaaggcagtggttttctgctcccagctcctttctctagtcaccctcagtttcctcgtcatgttcatcttctcaaagataagtttcaagtgtgtcatttccttcactcaatctccatggctcttcattgcctgccaagttaacaaccaagtcctcatggacatttgaatccttccaaaacttggcttatgtctttctggccttggagccctttatttccctagatttctagttccctatttcttcctaagcatgcagaagctccctctgatcaagcccttccctttgcttttgctagttgaagactggctacctgaagaccaactctggctgttgaaattctattcatcctataaggtgcttctcaagcataacctgcttctctggcactttcctgaagcaccagtgaaatattcaccaattcatcattcattcatccattccacaagtatttcagtgagcacggcaaagttccaattcccatgctgaatataggggatgcggggtgcacaaaaagaacagtgacccctacgcccatagatgttacggtctgtgggggagatgggcctcaagcaaatattctcacaagtcaatgcaaaattacactactgtgcatgctataaaaggaagatttgtgttactataatgcatgtaaactggacttaggaatatcgagagaggtgcccctgggaaagtgatgcttgaactgggctgtaaaggatgagtagccttgccaggcatagtggctcaggcctgtattctcagcactttgggaggccaaagcgggtggatcacttgagcctaggagttcgagaccggcctgggcaacatggcaaaactccacccctacaaaaaatacaaaaactatctggcatggtggcacacctgtagtatcagttactctagaggataacctgagcccagtaagtcaaggctgcagtgagctgtgatcatgccacagcactccagcctgggtgacagagtgagaccctgtttccaaaaaaaaaaaaaaaggataggttgcctctaagttggcaaagagaggaaggacaatggttaaagatggatacatgaatgcatgtgcaaaggccctgtggtggaagccccaccagtttattcaacacctatttgctggtgttggagatacagtggtgaacatggcccatggatggaactgaaagaaaactggtgtggcaggagcacagagcatggtgaggagggtgggcctggggcatgagaggcaggcatggccagcctgctccagttctggggcaattcaaaagactggtctctgttctaggagcaagggggagccttcaaacagctttaaggagggggtggtgatggctggacagggagatcatgagatacgtcatctcttctctgttgaaaccccagcacaatgcatgattgacttggtccactgggtcacaccatcatggatgggcattatctcccacaacagtccccatggggcaccacccagcacctgcccctgcctttctcatgtctattaatgacacccacccttgcatttggagcacctgaatcatctctgccacttgccttcatatctgatgggtcactcagtccagtcctttctctccatcctcgctttcactccatccccaaagtcatatctcaccttgaacattttctgctcagactgacaagtctccccgacgggaactcaccctctccacccaccacttccagatgaattgctcagaaacacaccctcatcttgcactctcctcttcaagaacaatcaggggctccctgttgcacacacagaaaaaaattgaaactgttttaccttgcagtcgagtttcttatttttcctgccccaaccctccttccttcctgttatcctttcagaagccaaatgggcagtttacagtcacagtgtgtgcccctgctttcctcacctctgtaccatcactcacgctgtgctttttgcctgcaattccccacactgtgtttaattgctgcctctgctggggggctgcaatagctgagtgggattctgtaccagaattggaaagatccatgttaactcttgcctgattctatctcccatgtcagcaggaagaggggctgccatccccacccctcccactctctaggaagactttcctccctcacccttcccttggggtgttttaggtgccctttatctgtaagttcataatatcccaggcttacagtaattcttccaaggcctttattgtgctataattatttattcatgaaagccttcccctatgaacttctaaagaataatcgtattatctttatttccccaactcttagtacaaatcctggcaactaaatgaaagaacaaacaacctggggttctgggatggttcgtctttgctgatggcactgtgttccaaaatggccaaggtcaaatataaaaatttcagactgaggtagacactgctggcagcctacacattgccaccacaccccacttccttcttcctagtggcaaggaagcagtgggtggagagggtgagttcctgtcagggagacttgtcagtctgagcagaaaatgttcaaagtgagatatgactttggggatggagacaaagggaggatggagagaaacgactggactgagagaagagcccactcccctttatgtaaattggctttgccaacctggtctgcagctggagaaaggccatgcgcctctattaccagccagtggggcttccgccttaggagggtcttagaaaagtgtttttccttaatgaaaggagatactgtgcagtaaatagccctgctgttgttttcttttcttttgatagaatgtcaaacttacgaaaaaagttacaagaagagaacaaagagctattagagggtgttgctgacacaatgctttatcactcttgaatattttcgtgtgtaattcctacaaataaggacattctcccacatagccacaatacaaccatcaaaatcaggaagttaacgctgatgtgtttctaccatgtaatcctcagatccaattcaagtgtcaccagctgtcccaataatgtcttttataacaaaaacattcagtctaagatcactcattctatttagttatcttgtctattcttcaatttggaagtgttctttgttctttcctgaatgttcatgaccttgacatcttagaagattaaaggttatttaaagttgttgagttaaatatccattaaattaggtttgtcagatatttcctcgaaattagattcagcttatgcattttttggaaggaataccacagaagtgatgttgttttctttctgttgcatccaatcagatgatacaggattttgatttgttccattactgttgacatgaattttgaacatttgataatgccagtatcagccagatttttccattgtaaagtcattcctttgtcctttgtatttaataagtatgtttagggactttgagactatgtcaatgtcctgttcttcatcaaaattccactcactcattcttagtattcattgacgtttactgatcgaactaattattattatgatagttgccaaatgttggtttttctaattcaatcatttctttagtgtttattagcattctactataaggaaaagcactatcttctccccatttattaattcacatatttacatcagcttggagttattgatttctattttattaaatagtttataattgattaccatccttatttattttaatgctcaaattgtcccaaattatggccaaagaaagctccttcaaactggttgctatgtccttttgacatggcccatcattctttaaacacattttacatctggcacaataacgtgctacatacccatcttgtatttttcctgccccatctttgaaatcagccattctcaaggggttccttcttaatctggctgttgttgtgttggaactcctggtaccatcttagaaccttaaggagacaagcgaaccaagccaataagctttccatgatgctgcttagagttaaacagagcccaggtactaagttatgtcatggagacagtgaactaacctctggactgcttgctacatgagacaattgattttcttattttctatgtagggtggtacatttcctcattttgagatatttcttcaacatatagcttttcattagtggggattttgtcaattataaccaaaaacaatgtgacggatacccaagatgtttcatgttgtagcttgggtgaattacacatttctgaagccattacacttcctagtttatttggatttaagttgacaaataaaaattgcatatgtttatggtctataacatggtgtttcgatatatgtatacatcgtggaatggctaaatcaagctaacatatccattacctcacatagttattttttgtggtgagaacattttaaaaatattgtcttagcaattttcaatcaagcctgtcccatggagacacaagcaatagtgacatgagcacttgactcgctgggttatcaggctttggctccaaatgtttggcttcaaatatgaaaaagttacatgaaagatgaaactatgcaatggcatggctgttggtcattcacatctctctctgccaagaatggggatgacgctgttgaaggaagaaatgtgttttctcctttttctcaagtgatatttgccttaggtcagattctactagtttaaagcaaaacgatctcctggtctgattcctttgggtctctaataatggaaactgcaaggatcagcataaagtgttcctttgttctgacgttggtataacattgcttcttgaaaaatgaaagtatttggacatacagacagaagcaatattattcaggtcttccttgttgcaagtgagggaaatccaattaaaactggtttaaacctaaaaaaaaaaaaaagaagaaaagaaaagaaaaaatatgagaggggttttgctttctggaatctgctttctagtcagaaagtgcagaagaagggctagcttcaggaacaattggatgcagtagttcaaatcacaagttaagtctctgcttcttttctccatctctcttctgtcttcctccacactggctttattcttaggtaggcttacccagatagtcataaacacagccaccagtggcagctgggctcacttttgtccttggagccagtgagcccatgaaaaaggagcttctctttctggagcttcccaggggtaactttgatcagccaacaagggtcagtcctatgcttatcccttgaccaatctctgtgcccagagggcagggtactctgattggcaataccttcatcgtgggccaaccactgtggggaagggggagggattagaaaagacagccacacccaaatctcatgaagcagtcccctttattttaaaaaagtccctgtgagagcaacaggagcaaagcatggagaagaagcaatcttggagaagctggaagagaactgacccaaagaatccaagagactaagactgtgcagggttggggaacggaagctcacacaggaggcctggacagagctgcagcagagccaggagagaagccaagtggcacagctcatcttgaagtaattataatgccactaaaattctcatttgtattaattttttttaattactggcaagataaggcaaatgtttttaaaggcctaaataaaatgatattccctgaaggaaa

SEQ ID NO: 149096 - DNA, 1501 bp, Homo sapiens
  Payload ID: 9444
  Gene Symbol: LMCD1
  Gene Name: LIM and cysteine-rich domains 1
  ENST ID: ENST00000397386
  CDS Start-End: 213-974
agctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggagggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccacatac

SEQ ID NO: 149097 - DNA, 1113 bp, Homo sapiens
  Payload ID: 9444
  Gene Symbol: LMCD1
  Gene Name: LIM and cysteine-rich domains 1
  Uniprot ID: Q9NZU5
  ENST ID: ENST00000454244
  CDS Start-End: 212-1090
attcagccgccgctgtccccgctgcgcgccctcgcgcctctgcctgagaagccaggcgctgttcccccaccccagaagaggatggcaaaggtggctaaggacctcaacccaggagttaaaaaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccaga

SEQ ID NO: 149098 - DNA, 870 bp, Homo sapiens
  Payload ID: 9444
  Gene Symbol: LMCD1
  Gene Name: LIM and cysteine-rich domains 1
  ENST ID: ENST00000415597
  CDS Start-End: 170-870
gcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatggtgatcacatgggatatacatataaagtaatcgagcgaatactggagattggtgcatttcgaccgcatatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccac

SEQ ID NO: 149099 - DNA, 1059 bp, Homo sapiens
  Payload ID: 9444
  Gene Symbol: LMCD1
  Gene Name: LIM and cysteine-rich domains 1
  ENST ID: ENST00000456506
  CDS Start-End: 52-228
ctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggagggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattcta

SEQ ID NO: 149100 - DNA, 1431 bp, Homo sapiens
  Payload ID: 9444
  Gene Symbol: LMCD1
  Gene Name: LIM and cysteine-rich domains 1
  ENST ID: ENST00000426878
  CDS Start-End: 133-876
agctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacaagccagtcccactcgtgtgataacccattaatctattaagccataagtggattaatccattcctgaggacctgagccctcacgacccaatcatctcttaaaggccccacctctcaatactgccatgcagaggattatgtttcaacctgagtgtttggaggggatgttcaacccataggaagtggcagtgtggaagaagtgctgctgaggagtgagtcactgggggccattttgagaaaacagaaaggagaagccagagttggggagatgaaagcctcatggcttggtttgtcttaaactgccccacagaaggcgaaaggaatgcttgaggctggaccacgtgggtctagcgtgtactgcgtttctggtccccagcccctgttttaccttttgctcctcctgccccatcaaccaagtgtcttcatttgtttctatggcaattaacttttggagatagaagtcccagcacacgagatccccaagcacattatctaccttgctgaacaggctggcagtcacacatgagccaggcgacccagggaaatgccagcccaaacaaagctgctgccacatcca

SEQ ID NO: 149101 - DNA, 1235 bp, Homo sapiens
  Payload ID: 9445
  Gene Symbol: LIMS1
  Gene Name: LIM and senescent cell antigen-like domains 1
  Uniprot ID: P48059
  ENST ID: ENST00000332345
  CDS Start-End: 120-1097
tagttcaagacaacagagacaaagctaagatgaggaagttctgtacagtttaggaaatagaggctttcaaagataattcgcagtgatgtgaaactggcctcccaagccctgataacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaa

SEQ ID NO: 149102 - DNA, 1876 bp, Homo sapiens
  Payload ID: 9445
  Gene Symbol: LIMS1
  Gene Name: LIM and senescent cell antigen-like domains 1
  Uniprot ID: P48059
  ENST ID: ENST00000338045
  CDS Start-End: 264-1427
acaaagactgtgtcactactttgtggaatgttattttagaacttccagaatgcctcagtaaatcctgactgccatgtaactgtgtactgtgctgctgagctcttaacatgaagcagcagtagtgaccctggcgggccaggctgacgtgcgtgggaacagtgggagtgaccctggctgggaagcagggaggcctggatattgtttctcctggctctgtgtcctgccattctcgtccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaa

SEQ ID NO: 149103 - DNA, 4392 bp, Homo sapiens
  Payload ID: 9445
  Gene Symbol: LIMS1
  Gene Name: LIM and senescent cell antigen-like domains 1
  Uniprot ID: P48059
  ENST ID: ENST00000393310
  CDS Start-End: 168-1145
actcttgaattaagagaaggggagctggaggtggctcaggtagagtgcgtaggtttgcagaactgggcctgtgtgtgtaaagtgactaaggcaaaggagtggaagtttgagagaagtttaagagaagaaatggacatgattgcctaaatcagccaaacacaggcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctgtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaacatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaattttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 149104 - DNA, 1526 bp, Homo sapiens
  Payload ID: 9445
  Gene Symbol: LIMS1
  Gene Name: LIM and senescent cell antigen-like domains 1
  Uniprot ID: P48059
  ENST ID: ENST00000410093
  CDS Start-End: 88-1077
gaggacacagtgagagggtgccatctatgagcatggagagcttagcttggacagccagctgatgagggacacatcgaatcaagatacatgacatgcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaa

SEQ ID NO: 149105 - DNA, 1627 bp, Homo sapiens
  Payload ID: 9445
  Gene Symbol: LIMS1
  Gene Name: LIM and senescent cell antigen-like domains 1
  Uniprot ID: P48059
  ENST ID: ENST00000409441
  CDS Start-End: 90-1178
cctcggcaagggacgctgctttcccctggcagccacactgctgagcataaatgctttaaagtgtcagcaattgatgtgtggagagaagtatgactgcattacagcttaaagagctttcacattcaggtctctacaggagaagacgagatcgccccgatagtttgagagtaaatgggttaccagaggaagagctaagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaa

SEQ ID NO: 149106 - DNA, 637 bp, Homo sapiens
  Payload ID: 9445
  Gene Symbol: LIMS1
  Gene Name: LIM and senescent cell antigen-like domains 1
  ENST ID: ENST00000428064
  CDS Start-End: 108-637
gctccgggcccgccagtagccggccgcggcggcgagggactaggacgcggctggagcggcgccgggagacgaggggctgagagacggcggcggccgaaagcggagagatgctgggcgtggcggccgggatgacccacagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgg

SEQ ID NO: 149107 - DNA, 439 bp, Homo sapiens
  Payload ID: 9445
  Gene Symbol: LIMS1
  Gene Name: LIM and senescent cell antigen-like domains 1
  ENST ID: ENST00000414829
  CDS Start-End: 23-376
tcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggaacgaacatgatggttaagctaccttcattaagcagcatgaccgcttcctgagctcctgctgccgcatttaggc

SEQ ID NO: 149108 - DNA, 1544 bp, Homo sapiens
  Payload ID: 9445
  Gene Symbol: LIMS1
  Gene Name: LIM and senescent cell antigen-like domains 1
  ENST ID: ENST00000422797
  CDS Start-End: 83-385
aagggacgctgctttcccctggcagccacactgctgagcataaatgctttaaagtgtcagcaattgatgtgtggagagaagtatgactgcattacagcttaaagagctttcacattcaggtctctacaggagaagacgagatcgccccgatagtttgagagtaaatgggttaccagaggaagagctaagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggtactggaattgtttcttttttattacacaagcagtgggaatgaaagattacatttatctatatttctgttactctagcaaaccaaattgtttttctccaatttttagtctagaaaattttaaacctatagacgagtcaagagaatgatataatgaaacctgtatacacttaatttcgtttcaccagttgacattttgccatgcttgtgtgtatacagtccacattctcgtttcaccctcctatgtatgtgtgcacgtgtgcctgtatacgcatacctctaaaatttctcatgagtcccagtatgcgtctcctgagaataagagcattttcctatggaaccacgatactttttgtaaatttttttttgccttgagacagggtctctctcgctctattgcccaggctgaagtgcagtgggcaatcagagctcactgcagcctcaccctcctgggctcaagcagtcctcccacttcagcctccagagtagctgagaccacaggcacacaccacccttcctgactaatttttttaaattttttgtagagatggagccttgctgcgttgcccaggctggtctcaaactcctgggctcaagcaatctactcatctcagccttccaaagtgctgggactataggcatgagccactgcacctggccagaaccacaatactcttattatgcctaagaaaattagcaataatcttataatatcaactatcagtccatattaaaaatattcccagtagccccagaaatatttgtcatcactatgtttttccaatcgaagatctaaaaacaaaaaaaggtcttatctctgtacatgcataacttttacagttgtaataattaggtattatcttaaaagatgttgttacatttatttaatttggcttggtttatatctaaaagaaatatatttaat

SEQ ID NO: 149109 - DNA, 779 bp, Homo sapiens
  Payload ID: 9445
  Gene Symbol: LIMS1
  Gene Name: LIM and senescent cell antigen-like domains 1
  ENST ID: ENST00000434274
  CDS Start-End: 52-219
ggcaaagggaaagttgtcttccagaggtgtggaggggagtgaagcaacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggaacgaacatgatggttaagctaccttcattaagcagcatgaccgcttcctgagctcctgctgccgcatttaggccctgtcagctgtgaggccactggtgctgagtcagagggaaaagctcagaacagccttgagcagtgaagaataaagtgtgactcatctcgtcctgcccacccctcacactggactataaataccctccctgggtctgtgtgctgttattccaaaagatgcgatgaatacccagaactaggctattcatgggctgttgcccagttcaagatctgttgggtcctgaggaagattactattttggctaaattgtttatcattaaaaccagcccagggatgtgtaaacctgcatctggagaataagacatttctttttggttaaatgatattagagaaaaaaactatccaagactgctaacaaataatcttcactttcagttatatccagcaataagttgttttccagaaaagaaagcttggaaacttacccagtttgccttccatttgggacatgactgatgtgcttcagtctttgtataataaatgcatcttcgccactc

SEQ ID NO: 149110 - DNA, 4461 bp, Homo sapiens
  Payload ID: 9445
  Gene Symbol: LIMS1
  Gene Name: LIM and senescent cell antigen-like domains 1
  Uniprot ID: P48059
  ENST ID: ENST00000544547
  CDS Start-End: 209-1222
agccgctcccgcccctcccccgccttcccgcgcggcccgcctcgccttcccccccctcccgcgcccccgcgcggccggcccctggccttcctccccttcctgctccgggcccgccagtagccggccgcggcggcgagggactaggacgcggctggagcggcgccgggagacgaggggctgagagacggcggcggccgaaagcggagagatgctgggcgtggcggccgggatgacccacagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctgtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaacatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaattttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgtt

SEQ ID NO: 149111 - DNA, 727 bp, Homo sapiens
  Payload ID: 9445
  Gene Symbol: LIMS1
  Gene Name: LIM and senescent cell antigen-like domains 1
  ENST ID: ENST00000542845
  CDS Start-End: 1-628
gaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaaggataagtttgttgaaattgacctaaagccagtctgcaaacactgttatgagaaaatgccagaagaatttaagaggcgacttgccaaacgggagagagaagcaaaggataaggacaagcagaaaaagaaaaagccagtctgtttgaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagag

SEQ ID NO: 149112 - DNA, 2111 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000324938
  CDS Start-End: 159-1256
gcgtaacgtgagctcgcgaccagcgcgggggaggcgcccacacgcccgtcccgtcttggtgtctggccccaggcggccgcgcctcccctccgaggtggtcccatagcccctgcaccaggcggcccgcgcccgcgacctcaaggcggctgccccgcgccatggcggcccggctgggtgcgctggccgcgtcggggctgtaccggcggcgccagcaccggcagagcccgccgccagccacgggcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 149113 - DNA, 2045 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000355119
  CDS Start-End: 167-1192
gccacccccgcccacccctctcgcgggcggagcggctcttggccttttttgggcgtctccctgctccgcggcccgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 149114 - DNA, 1678 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000409286
  CDS Start-End: 254-823
gtgacagggcagtctgctttcccataccctgggctgagcccctttgaagcccccagctgctcagtgaagttgcaggggtctggcctctcttctcctggaggtggccaggctgtgtgggagtgggggctctgcccctaatgcccccgcctcccgcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 149115 - DNA, 1620 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000409754
  CDS Start-End: 196-765
cagtgctgtgcaggatggagtccagacacccagcagtagcagaaatcgcctgtacgtgtttgggcccttcttcatctggcaaaccccgaaggaagggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 149116 - DNA, 2500 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000409455
  CDS Start-End: 637-1647
aagtgcatgactcaggactgggtgggagggggctgtccctgaggccctggtctcccccagccaagtcctggcagggggatgctgttcttcaggatcccatgacctggggctcttggggagccccagcccggagagtgacctgtggctttgctggggaaaggggcttggagggtacagggcagtgtccaggattgcagtctcaaatccgaggcccacaggggagctgcctctgtgatcgccattaaggctgtggcctggggtctcagggcagcccaggaaccaaaaatagcctgtaacttgtcactttgtaagtcctgccctccagacacacttccctttcttctccccaagcctctcttcccagttagctcccctgacttggagtcacctctaagccttggcccaggcccctctgcagtgagatggagggactcatcccccggagagtggcatctgcaggcccactggctgcctgtggtcaccccctagggttctagcggggctgcctcccattttcctcagagcatccctgccagctggctggttctcactctcctgttttctaggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 149117 - DNA, 1695 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000410038
  CDS Start-End: 315-884
aagatgcctgaagttctaacaccagagatggtttcctgctgcttccaggaacagggtctgttcttagtccaatgtggagttcctcatggggaccccattccccaggaatccaggttccacagtactctgacttggtctggctggtctcggctggcactttccctaggactgctaaaaccacggtgagggcggagagctgagggccgaagaaggcggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgttt

SEQ ID NO: 149118 - DNA, 2315 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000409808
  CDS Start-End: 452-1462
ctatactcccgcaacctcccaccgtcacctccccaacacccccaccaccctcagccttgacctccccatcccaccccgccccgcgggccccaccctgccacccccgcccacccctctcgcgggcggagcggctcttggccttttttgggcgtctccctgctccgcggcccgggctggcgggcgggcgctcggctggcggctgcagcagcagagggagacccgcggcaaccccggcaacccagggctcggcgtcgctgccaccatgacgggaagatgaggtcaccagaggccacagaggctgagccactcaggaggccagtcacaggtccaccagtgtccggccagtgtttgtccctgcagccctttctggaacctagctgggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 149119 - DNA, 867 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000409254
  CDS Start-End: 214-783
gcattctgaacttcagcacaaggcaaacgcagaaccagggcttggaatttcgccgctatgcagctgcacccctgccacccaggagatctgaggctcctcagagctgggaggaccgggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacc

SEQ ID NO: 149120 - DNA, 2335 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000410011
  CDS Start-End: 472-1482
ttttgcagtctgtccgtggatactgtgaacatcaggctactcggccgggctcctgcgctcagggcttcgagaaatgctcattttggggctgcccctctgccggcctctctggattcagagggcagccgctgctccttttgttttgtgggcctggctctgggcccggagcagcacctccctggggaggccgcctttccttccgcggcttcttccgtctcctcctgaccccaaggtgcctccggcctctgcctccagctaaggacctctggccaagcctcctgcccagggagaggtgaagctgccgtgcctgggtgccccgtggtggccggacactcctggcggctgctcagtcttgcacgtggctgtgccaagcgggccaggcagctgctatttccctcagagaagttgctggcggcgctcagggaaggaagcacccgaggaggcggagcggcatctcagccacagagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 149121 - DNA, 930 bp, Homo sapiens
  Payload ID: 9446
  Gene Symbol: LIMS2
  Gene Name: LIM and senescent cell antigen-like domains 2
  ENST ID: ENST00000413578
  CDS Start-End: 214-396
gcattctgaacttcagcacaaggcaaacgcagaaccagggcttggaatttcgccgctatgcagctgcacccctgccacccaggagatctgaggctcctcagagctgggaggaccgggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtggcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacagg

SEQ ID NO: 149122 - DNA, 1409 bp, Homo sapiens
  Payload ID: 9446
  Gene Symbol: LIMS2
  Gene Name: LIM and senescent cell antigen-like domains 2
  ENST ID: ENST00000426981
  CDS Start-End: 1-509
tgggcgtccccatctgcggggcctgccgccggcccatcgagggccgagtggtcaacgcgctgggcaagcagtggcacgtggaggtgagccaggctggtggacacgtggcctcaggttggggggtgccccagctcagggtcatgcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaaccacagcagcctgcgtggtttgtggcgggggtcgggggtggaggg

SEQ ID NO: 149123 - DNA, 1730 bp, Homo sapiens
  Payload ID: 9446
  Gene Symbol: LIMS2
  Gene Name: LIM and senescent cell antigen-like domains 2
  Uniprot ID: Q7Z4I7
  ENST ID: ENST00000545738
  CDS Start-End: 79-1170
gcgctcggctggcggctgcagcagcagagggagacccgcggcaaccccggcaacccagggctcggcgtcgctgccaccatgacgggaaggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcct

SEQ ID NO: 149124 - DNA, 1617 bp, Homo sapiens
  Payload ID: 9446
  Gene Symbol: LIMS2
  Gene Name: LIM and senescent cell antigen-like domains 2
  ENST ID: ENST00000612860
  CDS Start-End: 17-766
cacagtgctgtgcaggatggagtccagacacccagcagtagcagaaatcgcctgtacgtgttgggcccttcttcatctggcaaaccccgaaggaagggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcac

SEQ ID NO: 149125 - DNA, 1220 bp, Homo sapiens
  Payload ID: 9447
  Gene Symbol: LIMS3
  Gene Name: LIM and senescent cell antigen-like domains 3
  Uniprot ID: P0CW19
  ENST ID: ENST00000437679
  CDS Start-End: 302-655
cagtgtttatagcatagtccactgggactgccgctctgacaaagactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgaggaacgaacgtgatggttaagctaccttcattaagcagcatgaccgcttcctgagctcctgctgccgcatttaggccctgtcagctgtgaggccactggtgctgagtcagagggaaaagctcagaacagccttgagcagcgaagaataaagcatgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactcta

SEQ ID NO: 149126 - DNA, 1580 bp, Homo sapiens
  Payload ID: 9447
  Gene Symbol: LIMS3
  Gene Name: LIM and senescent cell antigen-like domains 3
  Uniprot ID: P0CW19
  ENST ID: ENST00000631420
  CDS Start-End: 83-829
gcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcggacaggaaggatctgactgccgatgcacaggagctgaaaggggagctatactgcctgccatgccatgataaaatgggggtccccatctgtggcgcttgccgacggcccatcgaagggcgtgtggtgaacgccatgggcaagcagtggcatgtggagcattttgtttgtgccaagtgtgagaaaccctttcttggacatcgccattatgagaggaaaggcctggcgtattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagtaagtgtacggttttgtccagtgtgaatcctaagactgaaaactttggggggacactgaaaaaaaatcctagaatttagaaaaagagaattatttgatttcttatttcctctttctgttcaggccttctgaaagtaaaggttcttcctttaactgttccctgttctttcttctattccttctttgtcctactcaaagggataagtttgttgaaattgacctaaagccagtctgcaaacactgttatgagaaaatgccagaagaatttaagaggcgacttgccaaacgggagagagaagcaaaggataaggacaagcagaaaaagaaaaagccagtctgtttgtaaacttttctatccctgtgtcatcattttcactactttctcctttggttagtcctttggaatatgtttttgttctgtttctgtcttttgctttcttccccc

SEQ ID NO: 149127 - DNA, 1197 bp, Homo sapiens
  Payload ID: 9447
  Gene Symbol: LIMS3
  Gene Name: LIM and senescent cell antigen-like domains 3
  ENST ID: ENST00000480744
  CDS Start-End: 1-1197
atggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggatctgactgccgatgcacaggagctgaaaggggagctatactgcctgccatgccatgataaaatgggggtccccatctgtggcgcttgccgacggcccatcgaagggcgtgtggtgaacgccatgggcaagcagtggcatgtggagcattttgtttgtgccaagtgtgagaaaccctttcttggacatcgccattatgagaggaaaggcctggcgtattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaaggataagtttgttgaaattgacctaaagccagtctgcaaacactgttatgagaaaatgccagaagaatttaagaggcgacttgccaaacgggagagagaagcaaaggataaggacaagcagaaaaagaaaaagccagtctgtttgtaa

SEQ ID NO: 149128 - DNA, 782 bp, Homo sapiens
  Payload ID: 9447
  Gene Symbol: LIMS3
  Gene Name: LIM and senescent cell antigen-like domains 3
  ENST ID: ENST00000487150
  CDS Start-End: 52-219
ggcaaagggaaagttgtcttccagaggtgtggaggggagtgaagcaacaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgaggaacgaacgtgatggttaagctaccttcattaagcagcatgaccgcttcctgagctcctgctgccgcatttaggccctgtcagctgtgaggccactggtgctgagtcagagggaaaagctcagaacagccttgagcagcgaagaataaagcatgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactc

SEQ ID NO: 149129 - DNA, 1215 bp, Homo sapiens
  Payload ID: 9448
  Gene Symbol: LIMS3L
  Gene Name: LIM and senescent cell antigen-like domains 3-like
  Uniprot ID: P0CW20
  ENST ID: ENST00000413601
  CDS Start-End: 298-651
gtttatagcatagtccactgggactgccgctctgacaaagactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgaggaacgaacgtgatggttaagctaccttcattaagcagcatgaccgcttcctgagctcctgctgccgcatttaggccctgtcagctgtgaggccactggtgctgagtcagagggaaaagctcagaacagccttgagcagcgaagaataaagcatgactcatctcgtcctgcccacccctcacactggactataaataccctccctgggtctgtgtgctgttattccaaaagatgcgatgaatacccagaactaggctattcatgggctgttgcccagttcaagctctattgggtcctgaggaagattactattttggctacattgtttatcattaaaaccagcccagggatgtgtaaacctgcatctggagaataagacatttctttttggttaaatgatattagagaaaaaaaaaactatccaaggctgctaacaaataatcttcactttcaattatatccagcaataagttgttctccagaaaagaaagcttggaaacttacccagtttgccttccatttgggacatgactgatgtgcttcagtctttgtataataaatgcatcttcgccactct

SEQ ID NO: 149130 - DNA, 1580 bp, Homo sapiens; identical to SEQ ID NO: 149126
  Payload ID: 9448
  Gene Symbol: LIMS3L
  Gene Name: LIM and senescent cell antigen-like domains 3-like
  ENST ID: ENST00000632758
  CDS Start-End: 83-829

SEQ ID NO: 149131 - DNA, 1460 bp, Homo sapiens
  Payload ID: 9448
  Gene Symbol: LIMS3L
  Gene Name: LIM and senescent cell antigen-like domains 3-like
  ENST ID: ENST00000632897
  CDS Start-End: 264-1460
acaaagactgtgtcactactttgtggaatgttattttagaacttccagaatgcctcagtaaatcctgactgccatgtaactgtgtactgtgctgctgagctcttaacatgaagcagcagcagtgaccctggcgggccaggctgacgtgcgtgggaacagtgggagtgaccctggctgggaagcagggaggcctggatattgtttctcctggctctgtgtcctgccattctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggatctgactgccgatgcacaggagctgaaaggggagctatactgcctgccatgccatgataaaatgggggtccccatctgtggcgcttgccgacggcccatcgaagggcgtgtggtgaacgccatgggcaagcagtggcatgtggagcattttgtttgtgccaagtgtgagaaaccctttcttggacatcgccattatgagaggaaaggcctggcgtattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaaggataagtttgttgaaattgacctaaagccagtctgcaaacactgttatgagaaaatgccagaagaatttaagaggcgacttgccaaacgggagagagaagcaaaggataaggacaagcagaaaaagaaaaagccagtctgtttgtaa

SEQ ID NO: 149132 - DNA, 4109 bp, Homo sapiens
  Payload ID: 9449
  Gene Symbol: LASP1
  Gene Name: LIM and SH3 protein 1
  Uniprot ID: Q14847
  ENST ID: ENST00000318008
  CDS Start-End: 332-1117
gcagtcagcctgagagcgctgaggcgccagcaccgcgggccccgccgtccccccaggaacccgcccccgcgcagccccacgtcgcccggagagcgcgcctcgctgcgcgtgcccttgcccgcgcccgaggcgcgtgcccgccccagtgcagcccctcctccccgctgtgtttattaggggaaggagggcggaggcggaggccagttccccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcgga

SEQ ID NO: 149133 - DNA, 762 bp, Homo sapiens
  Payload ID: 9449
  Gene Symbol: LASP1
  Gene Name: LIM and SH3 protein 1
  ENST ID: ENST00000419929
  CDS Start-End: 264-762
gtgccaggctgcaggcacagtgacacgaagcttgccacatcccccccaacccagagccacagagggacaggctgtcccaagtgaggggtatccttgcaggcttctgcccctaccagcctgtttacctttctttagagtgggttgcaggtaggcaagggaagatcaagatgaccctgccttggagcctcggatccaggctgagaggcctctaacaggcagcagagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtg

SEQ ID NO: 149134 - DNA, 3492 bp, Homo sapiens
  Payload ID: 9449
  Gene Symbol: LASP1
  Gene Name: LIM and SH3 protein 1
  Uniprot ID: Q14847
  ENST ID: ENST00000435347
  CDS Start-End: 48-833
ggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataattttt

SEQ ID NO: 149135 - DNA, 4023 bp, Homo sapiens
  Payload ID: 9449
  Gene Symbol: LASP1
  Gene Name: LIM and SH3 protein 1
  Uniprot ID: Q14847
  ENST ID: ENST00000433206
  CDS Start-End: 415-1032
gcagtcagcctgagagcgctgaggcgccagcaccgcgggccccgccgtccccccaggaacccgcccccgcgcagccccacgtcgcccggagagcgcgcctcgctgcgcgtgcccttgcccgcgcccgaggcgcgtgcccgccccagtgcagcccctcctccccgctgtgtttattaggggaaggagggcggaggcggaggccagttccccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcgtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcgg

SEQ ID NO: 149136 - DNA, 1482 bp, Homo sapiens
  Payload ID: 9449
  Gene Symbol: LASP1
  Gene Name: LIM and SH3 protein 1
  ENST ID: ENST00000443937
  CDS Start-End: 130-405
agttccccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcagatgaagaaaccgaggccaggggcttgagatgcagggcttctgtatctggagctacatttctctgcctctgagtgccctaccttccccgatgcccgcttcccaaagggcctcccactaagagtcaccgtgctggcccagggcttccaggactgaggaagagctggtgctaggtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtca

SEQ ID NO: 149137 - DNA, 1874 bp, Homo sapiens
  Payload ID: 9449
  Gene Symbol: LASP1
  Gene Name: LIM and SH3 protein 1
  ENST ID: ENST00000579123
  CDS Start-End: 1-318
cgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcggggtgagtaaccctggccggaggggagaggccagaggcagggggtccttcgggaaggcttggacacagctcatggattctcctgacctttgcacccaccctctgttgtgtgtgatgataaggatctcagccttgtgagcagagaggaaattggttggcgtagtgggcagaggctggctgggactggggccctgcgttccagccctggtgtaccatgggcaggttgctcaccctgctttgggtggggtttccttaccccagctacctgggaacacacaaggcaactttctgcatggggccttccagcactgggcgctgctctcctcgcttcatgaggatggcccccacatccttcagctctcaggctgcccctgcctctgaggggcctccccagccatgtcgtgtaaagcgcatcaccctgatgctttgcatcactcgactccgctggctgccttcagagcactttttccaactaaaaagagctcttcgtgttggtcaccttctctgtgtcccctgctgggctggggaccctggcagcgtccgtctggttcacctactctgagccaggcctagagcaagtgaataagcccagcaggaatggggtgagatcaggcttcctgagccctcagagctgaagtcccggctctgtaagtcctgccactcactccacccatgggtgccgctgagccacccttaccaagctcctggcaggctcagcgcctccaggctgggtgcctgggaattcaaagtagctcacgtaggagcagaacagatacttagagagataaaatcgcctgagataatggctggctggagtctgatgctctgggcacacaaacaaagggatgttaggactgcccagggcactgtgggcgcaagagttagtctgaagtataaggttccaggcagcccagccagtccctccctcctcaatgggtctgtcctggatgtgtagggtccatctctgaatataaagccacctctctgccctctgggggcttacattccagtcagggggacaaacaagaaaacaataagaaaataggtgtataacataaggtcagcggtgacacgctgtgaagagaaagacagcagggtgagggatggatagaaagcagctggattaagacatttggccgggggtggtggctcacgcctgtaatcccagcactttgggaggccaaggcgggcaggtcacttgaggtcaggagttcgagatcagcctggccaacatggtgaaaccccctgtctaccaaaaatacaaaaattagccaggtgtggtggtgtatgcctgtaacctgtaatcccagctactcgggaggctgaggcagtagaattgcttgaacccgagaggcagaggttgcagtgagccaagattgcactattgcactccagcctgggtgacagagcaatatctccaaagaaaaaagacatttggccgggtgcgatggctcacacctgtaatcccagcactttgggaggccaaagtgggcagatcacctgaggtcaggagttcgaaaccagcctggccaacatggtgaaaccctgtctctactaaaaatataaaattagctcggcatggtggtgcatgttcataatcccagctactcgggaggctgaggcaggagaattgcttgaacctgggaggtggaggttgcagtgagccgagatcacgccatttgcactccagcctg

SEQ ID NO: 149138 - DNA, 1408 bp, Homo sapiens
  Payload ID: 9449
  Gene Symbol: LASP1
  Gene Name: LIM and SH3 protein 1
  ENST ID: ENST00000585841
  CDS Start-End: 160-375
attaggggaaggagggcggaggcggaggccagttccccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcgtgcgctacaaggaggagtttgagaagaacaagggcaaaggtttcagcgtagtggcagacacgcccgagctccagagaatcaagaagacccaggaccagatcagtaacataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacct

SEQ ID NO: 149139 - DNA, 5647 bp, Homo sapiens
  Payload ID: 9450
  Gene Symbol: LMO7
  Gene Name: LIM domain 7
  ENST ID: ENST00000321797
  CDS Start-End: 722-4918
ggtattccacagtcgttctgtaatttgtaatcatagaaacagaatgttcctcctcttatttcttccctgccaacagtttctgggtgggtgaatgtcagtagctggagttatttttaaagaggagaggtgaggcttgccgtgcaaagctggaaagagggcgtttgtttgcagagcagagctgacatcaaagtgtagattactgctcagtggctaggcacttgtcctgtaacaggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtaatcagaggaggatttggggcaccaatgtggagaactggccaactgtacaaggaacttcaaagtcctcttgttatttggaagaggaaaaagcaaagacaagaagcatacccaacattgtaaaggatgatctttatgtgcgcaagctcagtccagtcatgccaaacccagggaatgcttttgatcagtttcttcccaaatgttggaccccagaagatgtgaactggaaaagaataaaaagggaaacttataagccatggtataaagaatttcagggattcagtcagtttttactgcttcaggccctccaaacatactctgatgacatcttgtcttctgaaacacataccaaaattgatcccacttctggcccaaggctcataacccgcaggaagaatctctcttatgcaccaggctatagaagagatgacctcgagatggcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaattccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagacttaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgca

SEQ ID NO: 149140 - DNA, 7237 bp, Homo sapiens
  Payload ID: 9450
  Gene Symbol: LMO7
  Gene Name: LIM domain 7
  Uniprot ID: Q8WWI1
  ENST ID: ENST00000341547
  CDS Start-End: 1261-5310
ggaaagaagtggaataattaggaacctagggtggggtagggtagcaggacatttcaaacattaatgagcatatgagattccaggtcttgttaaaatgcaaattctgattcagctggtaggtgaggtctgagattgtgcatttctaacaagcactcagataatcttaaggctgttggccccagggtcacacttatagtgattttctagaacccagttggggaagtgaatcttgggcaggagaaatacacacctcttgcattgagtttggagatctcatctgatataactttttaagaaagaaaaataattttccaaatatccaattgataagctttcccactaagtggctttcccactaagtggctgcgttatgaaaattgcttcactttgaaacttctggtcttggtaatatagaatttctgtgttctcacagtgcttgattgagaatatgatattgagattatggcataaaatatagtggctgtacaaaaaaaaatacattattaggatctctaacaattatgtaaaagtcattgcttcatgggtagagctcaaactttggtgtgagacctggttttattcttggcacttactctgagttgtcttaggcaaattaataccttaagcaaaaatattctcatgtacattttacatgagaattataaatgaagtacataaagtccagcagtcacaaatgttatctattattaccatcgtcctaagactgcaatcagctatagtgaaagtagtctcaaagattgtttcataaatcatcagattcacctaattttctaaagaatttaaataaggagatggaatgaatagattgcattttgtttccatgcacaggggaactgtgcatatttcttctgtgactcggaaatggtttaacttttaaaaatcccaaaatagctgaagttagcagacatgcaatttaccaaggatgattggaatttttatctttcctgtaataatactatacccaagcacactgctcatgaggaaaacatttttatgtgaatcttttactcttgggggcaaagaatgctgtttttctttttgataactatgtttatagaatctaaatcaccctgagcaattatttcaacatctaaagttattattaccattcatgtttcatttatagctatttgaattttgatgaatttcaatatggtgctacagtgatagggcaagtgcaaataagttcaatatatgggtacggtctaaagctattttaatttttttattacaactgctatgaagaaaattaggatatgccatattttcacgttttacagttggatgtcctatgatgttctcttccagagaacagagctcggagctctggaaatttggaggcaactgatatgtgctcatgtctgcatctgtgtgggttggctgtatctcagggacagagtctgcagcaaaaaagatataattttgaggactgaacaaaattcaggaaggactattctcattaaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatcaa

SEQ ID NO: 149141 - DNA, 8237 bp, Homo sapiens
  Payload ID: 9450
  Gene Symbol: LMO7
  Gene Name: LIM domain 7
  ENST ID: ENST00000357063
  CDS Start-End: 1306-6312
ggaaagaagtggaataattaggaacctagggtggggtagggtagcaggacatttcaaacattaatgagcatatgagattccaggtcttgttaaaatgcaaattctgattcagctggtaggtgaggtctgagattgtgcatttctaacaagcactcagataatcttaaggctgttggccccagggtcacacttatagtgattttctagaacccagttggggaagtgaatcttgggcaggagaaatacacacctcttgcattgagtttggagatctcatctgatataactttttaagaaagaaaaataattttccaaatatccaattgataagctttcccactaagtggctttcccactaagtggctgcgttatgaaaattgcttcactttgaaacttctggtcttggtaatatagaatttctgtgttctcacagtgcttgattgagaatatgatattgagattatggcataaaatatagtggctgtacaaaaaaaaatacattattaggatctctaacaattatgtaaaagtcattgcttcatgggtagagctcaaactttggtgtgagacctggttttattcttggcacttactctgagttgtcttaggcaaattaataccttaagcaaaaatattctcatgtacattttacatgagaattataaatgaagtacataaagtccagcagtcacaaatgttatctattattaccatcgtcctaagactgcaatcagctatagtgaaagtagtctcaaagattgtttcataaatcatcagattcacctaattttctaaagaatttaaataaggagatggaatgaatagattgcattttgtttccatgcacaggggaactgtgcatatttcttctgtgactcggaaatggtttaacttttaaaaatcccaaaatagctgaagttagcagacatgcaatttaccaaggatgattggaatttttatctttcctgtaataatactatacccaagcacactgctcatgaggaaaacatttttatgtgaatcttttactcttgggggcaaagaatgctgtttttctttttgataactatgtttatagaatctaaatcaccctgagcaattatttcaacatctaaagttattattaccattcatgtttcatttatagctatttgaattttgatgaatttcaatatggtgctacagtgatagggcaagtgcaaataagttcaatatatgggtacggtctaaagctattttaatttttttattacaactgctatgaagaaaattaggatatgccatattttcacgttttacagttggatgtcctatgatgttctcttccagagaacagagctcggagctctggaaatttggaggcaactgatatgtgctcatgtctgcatctgtgtgggttggctgtatctcagggacagagtctgcagcaaaaaagatataattttgaggactgaacaaaattcaggaaggactattctcattaaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtaatcagaggaggatttggggcaccaatgtggagaactggccaactgtacaaggaacttcaaagtcctcttgttatttggaagaggaaaaagcaaagacaagaagcatacccaacattgtaaaggatgatctttatgtgcgcaagctcagtccagtcatgccaaacccagggaatgcttttgatcagtttcttcccaaatgttggaccccagaagatgtgaactggaaaagaataaaaagggaaacttataagccatggtataaagaatttcagggattcagtcagtttttactgcttcaggccctccaaacatactctgatgacatcttgtcttctgaaacacataccaaaattgatcccacttctggcccaaggctcataacccgcaggaagaatctctcttatgcaccaggctatagaagagatgacctcgagatggcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaattccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagacttaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcatttaacgagtgggtcgtctttttcttaggtgtatgtgtctgacctcaggccttttagccatatttcagtatgtggccttttttgatgttatgttttatccagtagctttactaaggtataattgatgtaataaactgcatatatttaaagtgtatactttgacaaattttgacatggtgtataccttcgaaactatgccacagtctggatgtgtttactgaaacattttaataaggaagtttatttttgataaagttatgtttttggatacaatatatttgtatggtgagagtgatgaattgttggatcatttgaataaaatcttttactaaccccatgataaaaggagaagacaacagtgagcttagaatatctataaagcaaaaaatgtagtctcttgtttaaaaaatctggagcgggaatgcaaggatacaaaactttagcatgctttgagcaaaaatttaaacttactggaatcttttataataatgtaagtggaatggaggattctaggaactgagaactgtattggaataggttcaaaatatgtaagaaatgctaatgtgggagataaaaattttatttagtacttattctgattattattaaagtaataatgtgttccttgaggataacttgtcaaatgccccaaagcataaagaatataattctgaatcccaaattccaaagacaagaactctgtgtttgaattcattctgcatataattatttataagtatagattgtgaatttttccatgttcttaaaattatttttatcttttttcatggttgcatagtgctccattgtttggccttggtaatatttagttgataattccattactgtgtatttttcacttgtttctaagatcaaacattttaatatgtgcatgttatatataaatatgtaaattctgtgatactctatgatcatctctttctttatattattttcatagacatgaaatagttgctcagagattatgcattttaagacactcatagtatatattgccaaagtggtttccagaaaggcactgctggcttcgactcctataagcagcacgtgggcttgttcatctcactgcatgtttatgaagatacagttcttttgccttgttctctgcctgatgtgtatgcagaggcagccctcaatatgcagtggttgaataaatgaatgaagaaaccactatc

SEQ ID NO: 149142 - DNA, 3472 bp, Homo sapiens
  Payload ID: 9450
  Gene Symbol: LMO7
  Gene Name: LIM domain 7
  ENST ID: ENST00000377499
  CDS Start-End: 336-3472
gaagtccaaactgtcgtcggggctggtgccgcgcgctgccgctgggcacccgcttcgcttcccgcgtcctgcctgactgcccgggtccccgcgggccttgggtcgctttcaggagtttagagaaagccaggtcttcacgttcgtgtaggttcgagaccttaacgaactgcagagcgcaacaaagggaactagagccccggcgccttcgcagccggagcggaagccggagttgtgggaggcccgcgtgccctccccgcccgtggggcccagacgcgcggggacaacccctcccctccacgcatcccgagtctctctctccctcccttgtcctagccatggaagggctggaggaggcagaggccaactgctccgtggcgttcgctgaggctcagagatgggtggaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccac

SEQ ID NO: 149143 - DNA, 4896 bp, Homo sapiens
  Payload ID: 9450
  Gene Symbol: LMO7
  Gene Name: LIM domain 7
  ENST ID: ENST00000377534
  CDS Start-End: 1-4896
atggaagggctggaggaggcagaggccaactgctccgtggcgttcgctgaggctcagagatgggtggaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtaatcagaggaggatttggggcaccaatgtggagaactggccaactgtacaaggaacttcaaagtcctcttgttatttggaagaggaaaaagcaaagacaagaagcatacccaacattgtaaaggatgatctttatgtgcgcaagctcagtccagtcatgccaaacccagggaatgcttttgatcagtttcttcccaaatgttggaccccagaagatgtgaactggaaaagaataaaaagggaaacttataagccatggtataaagaatttcagggattcagtcagtttttactgcttcaggccctccaaacatactctgatgacatcttgtcttctgaaacacataccaaaattgatcccacttctggcccaaggctcataacccgcaggaagaatctctcttatgcaccaggctatagaagagatgacctcgagatggcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaattccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagacttaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtga

SEQ ID NO: 149144 - DNA, 3165 bp, Homo sapiens
  Payload ID: 9450
  Gene Symbol: LMO7
  Gene Name: LIM domain 7
  ENST ID: ENST00000447038
  CDS Start-End: 1-3165
atttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtcagtttttactgcttcaggccctccaaacatactctgatgacatcttgtcttctgaaacacataccaaaattgatcccacttctggcccaaggctcataacccgcaggaagaatctctcttatgcaccaggctatagaagagatgacctcgagatggcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaattccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagacttaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccac

SEQ ID NO: 149145 - DNA, 4121 bp, Homo sapiens
  Payload ID: 9450
  Gene Symbol: LMO7
  Gene Name: LIM domain 7
  ENST ID: ENST00000526202
  CDS Start-End: 81-3908
gtaacaggtaatgtttaacgtgccagtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaaggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctgactggggcaaagaccaaccttccctgccatttatacggcataaaaccctcaatctcaccagtatggctaccaaaattataggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacaggtcagtcagtgggaagcgcatatgctcctactgcaataacattctgggcaaaggagccgccatgatcatcgagtccctgggtctttgttatcatttgcattgttttaagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaa

SEQ ID NO: 149146 - DNA, 995 bp, Homo sapiens
  Payload ID: 9450
  Gene Symbol: LMO7
  Gene Name: LIM domain 7
  ENST ID: ENST00000497947
  CDS Start-End: 633-995
gacttttgaagggtggggtctgtaggaagaatccatgcattgctctgggaagtggcctcaggaagtagagggctggggacagaatcactcatgagttgcagttgttctgggcaacaaagcaaggcggatacttattctggtagcagggtggagtttgaactgggcagttacctctgctcaagccccttgaagaatttcagattccctgttaaccatggaggcatgggctggaagctgggtgtgggggcaggcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggat

SEQ ID NO: 149147 - DNA, 597 bp, Homo sapiens
  Payload ID: 9450
  Gene Symbol: LMO7
  Gene Name: LIM domain 7
  ENST ID: ENST00000489941
  CDS Start-End: 101-597
tgtgggtttcagttaggcgaataatctggagagtaaagcaaattcttgtgccttctttataggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgct

SEQ ID NO: 149148 - DNA, 672 bp, Homo sapiens
  Payload ID: 9450
  Gene Symbol: LMO7
  Gene Name: LIM domain 7
  ENST ID: ENST00000525373
  CDS Start-End: 98-672
gggtttcagttaggcgaataatctggagagtaaagcaaattcttgtgccttctttataggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaaggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgt

SEQ ID NO: 149149 - DNA, 650 bp, Homo sapiens
  Payload ID: 9450
  Gene Symbol: LMO7
  Gene Name: LIM domain 7
  ENST ID: ENST00000526371
  CDS Start-End: 154-650
agttagcagtggcagcactgggtttctaagggaaagacaaagcaggcgcgctgtgtgggtttcagttaggcgaataatctggagagtaaagcaaattcttgtgccttctttataggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtaatcagaggaggatttggggcaccaatgtggagaactggccaactgtacaaggaacttcaaagtcctcttgttatttggaagaggaaaaagcaaagacaagaagcatacccaacattgtaaaggatgatctttatgtgcgcaagctcagtccagtcatgccaaacccagggaatgcttttgatcagtttcttcccaaatgttggaccccagaagatgtgaactggaaaagaataaaaagggaaacttataagccatggtataaagaatttcagggattcag

SEQ ID NO: 149150 - DNA, 5580 bp, Homo sapiens
  Payload ID: 9450
  Gene Symbol: LMO7
  Gene Name: LIM domain 7
  ENST ID: ENST00000465261
  CDS Start-End: 761-4918
aacaggtaatgtttaacgtgccagtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgtaattggactttgaagcttcgaagttatatcataaaaatttgtaacctttgtctgagagagagctcagctaagcaatcactttccacttcttttcacaggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtaatcagaggaggatttggggcaccaatgtggagaactggccaactgtacaaggaacttcaaagtcctcttgttatttggaagaggaaaaagcaaagacaagaagcatacccaacattgtaaaggatgatctttatgtgcgcaagctcagtccagtcatgccaaacccagggaatgcttttgatcagtttcttcccaaatgttggaccccagaagatgtgaactggaaaagaataaaaagggaaacttataagccatggtataaagaatttcagggattcagtcagtttttactgcttcaggccctccaaacatactctgatgacatcttgtcttctgaaacacataccaaaattgatcccacttctggcccaaggctcataacccgcaggaagaatctctcttatgcaccaggctatagaagagatgacctcgagatggcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaattccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagacttaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaagaaaaaagaagagagagaagaaattgaaaagcaggcacttgagaagtctaagagaagctctaagacgtttaaggaaatgctgcaggacagggaatcccaaaatcaaaagtctacagttccgtcaagaaggagaatgtattcttttgatgatgtgctggaggaaggaaagcgaccccctacaatgactgtgtcagaagcaagttaccagagtgagagagtagaagagaagggagcaacttatccttcagaaattcccaaagaagattctaccacttttgcaaaaagagaggaccgtgtaacaactgaaattcagcttccttctcaaagtcctgtggaagaacaaagcccagcctctttgtcttctctgcgttcacggagcacacaaatggaatcaactcgtgtttcagcttctctccccagaagttaccggaaaactgatacagtcaggttaacatctgtggtcacaccaagaccctttggctctcagacaaggggaatctcatcactccccagatcttacacgatggatgatgcttggaagtataatggagatgttgaagacattaagagaactccaaacaatgtggtcagcacccctgcaccaagcccggacgcaagccaactggcttcaagcttatctagccagaaagaggtagcagcaacagaagaagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaagcatcttcaggttttcttcctggtgacaggaataaatccagatctactactgaactggatgattactccacaaataaaaatggaaacaataaatatttagaccaaattgggaacatgacctcttcacagaggagatccaagaaagaacaagtaccatcaggagcagaattggagaggcaacaaatccttcaggaaatgaggaagagaacaccccttcacaatgacaacagctggatccgacagcgcagtgccagtgtcaacaaagagcctgttagtcttcctgggatcatgagaagaggcgaatctttagataacctggactccccccgatccaattcttggagacagcctccttggctcaatcagcccacaggattctatgcttcttcctctgtgcaagactttagtcgcccaccacctcagctggtgtccacatcaaaccgtgcctacatgcggaacccctcctccagcgtgcccccaccttcagctggctccgtgaagacctccaccacaggtgtggccaccacacagtcccccaccccgagaagccattccccttcagcttcacagtcaggctctcagctgcgtaacagtgtgttgcctgtgagtgtgacctcggaggctcttcctcaggagctgaagtcaggatcagaaaccaccaactgtactgcaacgactgctatctcagattcaaatctggacggccaaccgccatgtgatgtaagcctccatacgaaagcactgttgcagatagaagaagaggtggttgctgctcatgtagatctataaatatgtgttgtatgtcttttttgctttttttttaaaaaaaagaataactttttttgcctctttagattacatagaagcattgtagtcttggtagaaccagtatttttgttgtttatttataaggtaattgtgtgtggggaaaagtgcagtatttacctgttgaattcagcatcttgagagcacaagggaaaaaataagaacctacgaatatttttgaggcagataatgatctagtttgactttctagttagtggtgttttgaagagggtattttattgttttttaaaaaaaggttcttaaacattatttgaaatagttaatataaatacataattgcatttgctctgtttattgtaatgtattctaaattaatgcagaaccatatggaaaatttcattaaaatctatccccaaatgtgctttctgtatccttccttctacctattattctgatttttaaaaatgcagttaatgtaccatttatttgcttgatgaagggagctctattttctttaccagaaatgttgctaagtaattcccaatagaaagctgcttattttcattaatgaaaaataaccatggtttgtatactagaagtcttcttcagaaactggtgagcctttctgttcaattgcatttgtaaataaacttgctgatgcattt

SEQ ID NO: 149151 - DNA, 914 bp, Homo sapiens
  Payload ID: 9450
  Gene Symbol: LMO7
  Gene Name: LIM domain 7
  ENST ID: ENST00000524651
  CDS Start-End: 1-914
aagatgtgacaaggctgccctctcctacatcccccttctcatctctttcccaagaccaggctgccacttctaaagccacattgtcttccacatctggtcttgatttaatgtctgaatctggagaaggggaaatctccccacaaagagaagtctcaagatcccaggatcagttcagtgatatgagaatcagcataaaccagacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctgactggggcaaagaccaaccttccctgccatttatacggcataaaaccctcaatctcaccagtatggctaccaaaattataggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgag

SEQ ID NO: 149152 - DNA, 874 bp, Homo sapiens
  Payload ID: 9450
  Gene Symbol: LMO7
  Gene Name: LIM domain 7
  ENST ID: ENST00000525914
  CDS Start-End: 1-874
taacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattccaagtacttggatgaggaactgatggtcctaagctcaaacagcatgtctctgaccacacgggagccctctcttgccacctgggaagctacctggagtgaagggtccaagtcttcagacagagaaggaacccgagcaggagaagaggagaggagacagccacaagaggaagttgttcatgaggaccaaggaaagaagccgcaggatcagcttgttattgagagagagaggaaatgggagcaacagcttcaggaagagcaagagcaaaagcggcttcaggctgaggctgaggagcagaagcgtcctgcggaggagcagaagcgccaggcagagatagagcgggaaacatcagtcagaatataccagtacaggaggcctgttgattcctatgatataccaaagacagaagaa

SEQ ID NO: 149153 - DNA, 572 bp, Homo sapiens
  Payload ID: 9450
  Gene Symbol: LMO7
  Gene Name: LIM domain 7
  ENST ID: ENST00000526528
  CDS Start-End: 150-572
agcagtggcagcactgggtttctaagggaaagacaaagcaggcgcgctgtgtgggtttcagttaggcgaataatctggagagtaaagcaaattcttgtgccttctttataggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagtcagtttttactgcttcaggccctccaaacatactctgatgacatcttgtcttctgaaacacataccaaaattgatcccacttctggcccaaggctcataacccgcaggaagaatctctcttatgcaccaggctatagaagagatgacctcgagatggcagccctggatcctgacttagagaatgatgatttctttgtcagaaagact

SEQ ID NO: 149154 - DNA, 589 bp, Homo sapiens
  Payload ID: 9450
  Gene Symbol: LMO7
  Gene Name: LIM domain 7
  ENST ID: ENST00000534657
  CDS Start-End: 553-589
agtcctatagtatggtttccctgcctgtcaagagccagctcaacaaccaaacccagattccaggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaa

SEQ ID NO: 149155 - DNA, 536 bp, Homo sapiens
  Payload ID: 9450
  Gene Symbol: LMO7
  Gene Name: LIM domain 7
  ENST ID: ENST00000525107
  CDS Start-End: 1-536
agacgcctgggaagagtcttgactttgggtttacaataaaatgggatattcctgggatcttcgtagcatcagttgaagcaggtagcccagcagaattttctcagctacaagtagatgatgaaattattgctattaacaacaccaagttttcatataacgattcaaaagagtgggaggaagccatggctaaggctcaagaaactggacacctagtgatggatgtgaggcgctatggaaaggctggttcacctgaaacaaagtggattgatgcaacttctggaatttacaactcagaaaaatcttcaaatctatctgtaacaactgatttctccgaaagccttcagagttctaatattgaatccaaagaaatcaatggaattcatgatgaaagcaatgcttttgaatcaaaagcatctgaatccatttctttgaaaaacttaaaaaggcgatcacaattttttgaacaagggtcatcaggcttttcttacagttcatgggtctacctctgtggaagctctgattcggtggttcctgat

SEQ ID NO: 149156 - DNA, 578 bp, Homo sapiens
  Payload ID: 9450
  Gene Symbol: LMO7
  Gene Name: LIM domain 7
  ENST ID: ENST00000533809
  CDS Start-End: 282-578
catttgaaattctttttttttttttttttcctgttaggccaaactatgagatgctgcccagtttattaataaaagaaccctgaagcttcttcagaaatatccattgatcctactctaatacctagagctagggtttattttggcatctgtatcttccttttactaactttgaatttgaaagatgagtaacagatggaactgttacacctggagaaaaaaggatttactgactattgtttaaaaaaacattgtcacttagtatactggcatagagacagctaatgatagaagtttctgaaaggaattatttcatagaaatgaagacttatattgtatatttttcttccttgcccatgtgctgcaacacaggaagctctgattcggtggttcctgatcttccagttccaaccatcagtgccccgagtcgctgggtgtgggatcaagaggaggagcggaagcggcaggagaggtggcagaaggagcaggaccgcctactgcaggaaaaatatcaacgtgagcaggagaaactgagggaagagtggcaaagggccaaacaggaggcagagagagagaattcc

SEQ ID NO: 149157 - DNA, 3706 bp, Homo sapiens
  Payload ID: 9451
  Gene Symbol: LIMA1
  Gene Name: LIM domain and actin binding 1
  Uniprot ID: Q9UHB6
  ENST ID: ENST00000341247
  CDS Start-End: 151-2430
ggggtccggggcggggccgcaggagcagtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 149158 - DNA, 3669 bp, Homo sapiens
  Payload ID: 9451
  Gene Symbol: LIMA1
  Gene Name: LIM domain and actin binding 1
  Uniprot ID: Q9UHB6
  ENST ID: ENST00000394943
  CDS Start-End: 111-2393
gcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactccccaggtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 149159 - DNA, 583 bp, Homo sapiens
  Payload ID: 9451
  Gene Symbol: LIMA1
  Gene Name: LIM domain and actin binding 1
  ENST ID: ENST00000551691
  CDS Start-End: 193-583
aggtagagcgccgggacctgtgacagggctggtagcagcgcagaggaaaggcggcttttagccagttttcaagactcctggatcagaaacaaagtggtactttatatttttcactcttcaaataaggaaactgttgactcatttctaatctctcgtcttctggacaaaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactca

SEQ ID NO: 149160 - DNA, 2457 bp, Homo sapiens
  Payload ID: 9451
  Gene Symbol: LIMA1
  Gene Name: LIM domain and actin binding 1
  ENST ID: ENST00000552720
  CDS Start-End: 61-1227
ctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagcttctgcctcctgctcctggtacctaatttctgctcctgccttccactttcctcctaataagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctt

SEQ ID NO: 149161 - DNA, 2652 bp, Homo sapiens
  Payload ID: 9451
  Gene Symbol: LIMA1
  Gene Name: LIM domain and actin binding 1
  ENST ID: ENST00000552491
  CDS Start-End: 6-1376
ataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 149162 - DNA, 3920 bp, Homo sapiens
  Payload ID: 9451
  Gene Symbol: LIMA1
  Gene Name: LIM domain and actin binding 1
  Uniprot ID: Q9UHB6
  ENST ID: ENST00000547825
  CDS Start-End: 1271-2644
tgggtcgtaatctagaataccatcactaggtgactaagtcatactcacattcctttcattgacctggtggccataaattgtttcctcccatgcctaaagattcacagagaacagaaaagtactagattactacattattagcagactaatggtgggaaatgtctatagtcatcgacctctatgtttattttattttattttatttttttattttgagatggagtttcactcttgttccccaggctggagtgcagtggcgtgatctcggctcactgcaacctctgcctccctgattcaagcgattctcctgcctcagcctcccaagtaactgggattacaagtgtgcaccaccacacgtggctaattttttgtatttttagtagagacaggatttcaccatgttcgccaggctggtcttgaactcctgacctcaggcgatccacccgcctcagcttcccaaagtgctgggattacaggcgtgagccactgcacccaggttctatgttgattttagatgtaatagatgagttaattgtaatattcaccccagtgtcctttgcaaggaaaaaaatgcaattatccttattccttatgacaataaaatgcatgttcttttatgttgaggctctgttttgagaagtaaaataaattatgtctttagtacaatatatgaattgtatatggaaaaacatgctttttgaaagtcccaccaaaaaggtttctttatggtatcattaaatataatttcagtttttatatgtatacatcatccctgtctctctttccaggccgggcatttatatatgtatggtcagtatattttctattattggcacttggcatctcctttcccctgctccagaatggtcttttctgataaaactcacaagctttgcattaccacaagctctgctgctagaagagtgaatcacaagaatgttgtatgcttggggtgttctgtgtgcctgtgttgatgtgtctgtattctaatgagcaatccagttttacactagcatacagatatttaactctgaggtatgtgtccacaaagctgcttttgtcatttcactagtcagtgggttttgcttgtgagagttagggggttgatttgacccgaggcttcttagaagaattttttaacattccaagtttatctaatagatgtgctatgaagagaacagaatgatgggactttaaaaaaatttttacagttatttttattttgtagaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 149163 - DNA, 3612 bp, Homo sapiens
  Payload ID: 9451
  Gene Symbol: LIMA1
  Gene Name: LIM domain and actin binding 1
  Uniprot ID: Q9UHB6
  ENST ID: ENST00000552783
  CDS Start-End: 536-2338
ttcctgcttcagctcctgagtttttctctcttcccctctccctctccctctgccgggtggatgctttctccatgtggcaaggctgtaactgttcacagctgtctgaaacagcagtggaccaggagcagcttggagttttaactttcattttacaaagaacaacatgtttgaatgtttcagcaggcaagttataactggcatctacttcttgttcttctagaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactccccaggtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttg

SEQ ID NO: 149164 - DNA, 567 bp, Homo sapiens
  Payload ID: 9451
  Gene Symbol: LIMA1
  Gene Name: LIM domain and actin binding 1
  ENST ID: ENST00000550592
  CDS Start-End: 235-567
agatcagttatgctcttcggttgccaagagctgcaagtagtactttatttttcttttacttctggtaagctgtgaattagcagtactttattattatttttttttagttttcaagactcctggatcagaaacaaagtggtactttatatttttcactcttcaaataaggaaactgttgactcatttctaatctctcgtcttctggacaaaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccac

SEQ ID NO: 149165 - DNA, 2162 bp, Homo sapiens
  Payload ID: 9451
  Gene Symbol: LIMA1
  Gene Name: LIM domain and actin binding 1
  ENST ID: ENST00000552909
  CDS Start-End: 187-1983
cacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacaca

SEQ ID NO: 149166 - DNA, 3254 bp, Homo sapiens
  Payload ID: 9451
  Gene Symbol: LIMA1
  Gene Name: LIM domain and actin binding 1
  Uniprot ID: Q9UHB6
  ENST ID: ENST00000552823
  CDS Start-End: 179-1978
agaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaa

SEQ ID NO: 149167 - DNA, 2285 bp, Homo sapiens
  Payload ID: 9452
  Gene Symbol: LDB1
  Gene Name: LIM domain binding 1
  Uniprot ID: Q86U70
  ENST ID: ENST00000361198
  CDS Start-End: 625-1752
gggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccggactccccgcggccccccgccccccaggccggccccctggcccccggcccccggcccagtggccattgtaactttcccccgggacagcggccgccgcggggcgggccgaggcagtgcgtgcgagtctttgtgcggccggcggactggagctcccagtcgggcctgcccgtcccactcgggacatgagctgctgaagttgtccccccgtcagccctcacccctgccaggactcctctgggcttgcagtcgctcccccgtacctctcctggccccctcagttctcccaggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagttaaaaaaaaaa

SEQ ID NO: 149168 - DNA, 2089 bp, Homo sapiens
  Payload ID: 9452
  Gene Symbol: LDB1
  Gene Name: LIM domain binding 1
  Uniprot ID: Q86U70
  ENST ID: ENST00000425280
  CDS Start-End: 344-1579
cgagggcggagaggggggcgctcggcgacggcggcgggagcgcacagacacgcacacgcacacgcgcacacacgcacacacggacacacactccgcggactcacacccgcgcgcacacacgcagaggccgctcgccttcctgcctggcttccttcctgtctgctccgcgcctgacaggcccctcgccgcagccaggggccgcccgcaccgggccgaggccgggccgggccggcggcgagcgcagcgggggccgcgggcggcggcggcggctcatgcccggcctgtccccgcgaggggcgggcaccgtgactcggctgggcccccagaggcgggcgatgtgaagatgtcagtgggctgtgcctgtcctggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattatt

SEQ ID NO: 149169 - DNA, 2548 bp, Homo sapiens
  Payload ID: 9453
  Gene Symbol: LDB2
  Gene Name: LIM domain binding 2
  Uniprot ID: O43679
  ENST ID: ENST00000304523
  CDS Start-End: 325-1446
ccctccctcccttcttccctcccttcctccataccaacctccctccctctctggagctcctgctctctccctctccctcctctcccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 149170 - DNA, 2476 bp, Homo sapiens
  Payload ID: 9453
  Gene Symbol: LDB2
  Gene Name: LIM domain binding 2
  Uniprot ID: O43679
  ENST ID: ENST00000441778
  CDS Start-End: 110-1105
gtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 149171 - DNA, 567 bp, Homo sapiens
  Payload ID: 9453
  Gene Symbol: LDB2
  Gene Name: LIM domain binding 2
  ENST ID: ENST00000506732
  CDS Start-End: 75-567
gagggctccgacagcagttcccagccagcgtgttcagcctgcctgcctgcctgcctctgaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtcca

SEQ ID NO: 149172 - DNA, 2295 bp, Homo sapiens
  Payload ID: 9453
  Gene Symbol: LDB2
  Gene Name: LIM domain binding 2
  ENST ID: ENST00000515064
  CDS Start-End: 78-1193
gggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 149173 - DNA, 2626 bp, Homo sapiens
  Payload ID: 9453
  Gene Symbol: LDB2
  Gene Name: LIM domain binding 2
  ENST ID: ENST00000502640
  CDS Start-End: 150-1091
agcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatga

SEQ ID NO: 149174 - DNA, 923 bp, Homo sapiens
  Payload ID: 9453
  Gene Symbol: LDB2
  Gene Name: LIM domain binding 2
  ENST ID: ENST00000512345
  CDS Start-End: 137-457
tgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacagaaccaagaatttaagaccaattggggaaaaaatgaatattaatggaaaatgctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccg

SEQ ID NO: 149175 - DNA, 1498 bp, Homo sapiens
  Payload ID: 9453
  Gene Symbol: LDB2
  Gene Name: LIM domain binding 2
  ENST ID: ENST00000508918
  CDS Start-End: 150-482
agcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacattgtgcattcagcggcagatgccagaggaaactgcaaccagctcggggattcggaaccagatgcctgtgatggattattacaatttcctatcatgtaattgcttttctgtttgaccaaagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattaga

SEQ ID NO: 149176 - DNA, 1485 bp, Homo sapiens
  Payload ID: 9453
  Gene Symbol: LDB2
  Gene Name: LIM domain binding 2
  ENST ID: ENST00000507464
  CDS Start-End: 1-884
ctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaa

SEQ ID NO: 149177 - DNA, 3873 bp, Homo sapiens
  Payload ID: 9454
  Gene Symbol: LDB3
  Gene Name: LIM domain binding 3
  Uniprot ID: O75112
  ENST ID: ENST00000263066
  CDS Start-End: 1-1854
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagga

SEQ ID NO: 149178 - DNA, 5297 bp, Homo sapiens
  Payload ID: 9454
  Gene Symbol: LDB3
  Gene Name: LIM domain binding 3
  Uniprot ID: O75112
  ENST ID: ENST00000361373
  CDS Start-End: 22-2205
gcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgcaaa

SEQ ID NO: 149179 - DNA, 1868 bp, Homo sapiens
  Payload ID: 9454
  Gene Symbol: LDB3
  Gene Name: LIM domain binding 3
  Uniprot ID: O75112
  ENST ID: ENST00000372056
  CDS Start-End: 1-1197
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggaggcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaa

SEQ ID NO: 149180 - DNA, 1598 bp, Homo sapiens
  Payload ID: 9454
  Gene Symbol: LDB3
  Gene Name: LIM domain binding 3
  Uniprot ID: O75112
  ENST ID: ENST00000372066
  CDS Start-End: 80-931
gcaggcggagtgcctgagtgccctctcactcaaccctctctaccctttgtctgcagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaag

SEQ ID NO: 149181 - DNA, 5436 bp, Homo sapiens
  Payload ID: 9454
  Gene Symbol: LDB3
  Gene Name: LIM domain binding 3
  Uniprot ID: O75112
  ENST ID: ENST00000429277
  CDS Start-End: 146-2344
acagtccatttatgggcgcagccgaaggcagatatcagtgtcgatggcattcgctcccagctattcttaggagcctctcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggaggcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaaggaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaacaaaaaaacaaaaaaaaaaccacttaaaaggtagcaggaaaagaaggtagttttgagtgtggttcactcagtgtctgtgagtctggtgtagtgtcaggagtaaggccgtgtctagctcaagtttacatttggatgtcctacaacactaaacaaaatttttcataatccatggtggggagcacactttggagctacatttcttgtctcctcattgttgacattaattaaacatttataggccaggcacagtggctcacgcctgttatcccagcactttgggaggccgaggcaggtgaatcacctgaggtcaggagtttgaaaccagcctggccaatatggtgaaaccccatctctactaaaaatacacaaaattagccaggtgtggtggcaggcgcctgtagttccagctacttgggaggctgaggcaggaatctcctgaatcctggaggcggaggttgcagtgagccgagattatgccattgcactccagcctgggcaacaggagcgaaactccgttgcaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgtttttttttttgcctgtgtgaattctactttttagcaaaaataaagccccccaaaggatgtgcaaa

SEQ ID NO: 149182 - DNA, 1889 bp, Homo sapiens
  Payload ID: 9454
  Gene Symbol: LDB3
  Gene Name: LIM domain binding 3
  ENST ID: ENST00000542786
  CDS Start-End: 1-696
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtg

SEQ ID NO: 149183 - DNA, 1664 bp, Homo sapiens
  Payload ID: 9454
  Gene Symbol: LDB3
  Gene Name: LIM domain binding 3
  Uniprot ID: O75112
  ENST ID: ENST00000623007
  CDS Start-End: 1-993
atgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaa

SEQ ID NO: 149184 - DNA, 2314 bp, Homo sapiens
  Payload ID: 9454
  Gene Symbol: LDB3
  Gene Name: LIM domain binding 3
  Uniprot ID: O75112
  ENST ID: ENST00000623056
  CDS Start-End: 91-2289
agctattcttaggagcctctcaagagctccacgcagcccggctgggcagcaagggacagaacaggcaaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggaggcgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacg

SEQ ID NO: 149185 - DNA, 433 bp, Homo sapiens
  Payload ID: 9454
  Gene Symbol: LDB3
  Gene Name: LIM domain binding 3
  ENST ID: ENST00000477489
  CDS Start-End: 1-246
gtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtatgtctctagcttggggctctggctttctgagaagaggcaggagggaggaagtgggagccagatgaccaacctctacataccttgccacgctagctttctgacatcctgatcatttttaaaagctggcaaacaccatgatgcctcgatacatcacagtcgaacaaagtttcattcctaataattatttataaaccaa

SEQ ID NO: 149186 - DNA, 3193 bp, Homo sapiens
  Payload ID: 9455
  Gene Symbol: LIMD2
  Gene Name: LIM domain containing 2
  Uniprot ID: Q9BT23
  ENST ID: ENST00000259006
  CDS Start-End: 160-543
cggcggtggctcggggaccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctattgtgtggcctgctgggggatctgtcacaggaagggtgcagactcaccatggggcgggcatggggggacagggccagccccgactacctcggccctgatgggggcagggagctagaagtgggtgtcagttccctgacacaccattgagaaatgggagggctcctcttcacagcgagggcttcatgctgtcacacccacagtggttttggaactgaaactccacctcacccctcagttctgggttggttcagacccaccaacttaccatatgcaccccattgtgaagaggcctgagagcgggagggccaggctgccagtgggtgatggcgcctgtcctcgctgcacttcagtgcctggggtgcaagctgccgcgttccctggctggttccagctgtctagctccctcccttcttcccagccctttgacctggaagtaagttagcgaagaatggcggtaaccagcagacccagcaagtgctgcccaaggttttagtgacccctggattgtcccccctcatcattacccctcgctgctgtcatcatccccttgccttttcaagctctgcggaggtgcagtcacagctactgtctcaggaaatccaaagagaaactacctctgcttctctgaaaacccagggacaatgagggatgagttcacagcagagcaaaccaggcaagttgggaggacctgagggcgccccggtgggacacaggcagaagtctgggttgtcctgctccagattcaacttcctgatgtctccagacatgggatcgatgagaacagagactcctggagggtttgctgccaccacaccatacaactgcctgagttcctaagtggcctccccgtggaacagggcagggagctgggccacaggctccagtgtcacataagtcactatgctgaggcaggcactgctcctcgagggagcagagcgaatactcagcagagatggtgccccggcctggatcctcccaagtgtgaagtgagcgcctcagagcctctcagggcaggccaacttcctgcaccagaggtctcagatggcaaggatcatcttggttcggttaagcaacagtagcagatgaccacaagggggtactggagaggtggctcttggagacacctgacccctgccctgcaaagatgggactgaaggaagtcctctgggccaggaagaccctaccaaatatcatgaaagctccgggaactcagccactggtgacgttcaggttgtgagggccagcagtgccaccctggtaaatcagccctgttgggaccaccccagtggagctcctggaggggcaactggaggaaaggggcagacacctctggactgacaatggtatcagccagatcaccccaggacccctctacttggagtcaagttctcttctgcttgaaaggcccaggctcgttgccaggcaccatacctggcccctgctaagcaaaaacctacctccaccccccacaactgaaagcactgccacaggacccctctgatataaatgatcccttttattgtaagtaatgcgcaacactggcctggctttgcactgcaagccctcggtcaagatatagtcaaataactatggctgcaggttccacagttccacaataaccatggctgcacgatccacaattcagacacagacatagagctggggtgggtggaaggggcaggagggtggcagagtgcggactgtccccagccctggcctctccatgcagagttggcccaggcagacacaccccatggaatgatgagaaagtgacggcacggccccttcccacagcaagcctggggctgccaggaactgcccttcagaacctttgggcccaggtcaccctgaagccccacaactttttatctggattagttattaaaaaacaataaattaagcaac

SEQ ID NO: 149187 - DNA, 602 bp, Homo sapiens
  Payload ID: 9455
  Gene Symbol: LIMD2
  Gene Name: LIM domain containing 2
  ENST ID: ENST00000578993
  CDS Start-End: 122-385
cgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgccca

SEQ ID NO: 149188 - DNA, 1534 bp, Homo sapiens
  Payload ID: 9455
  Gene Symbol: LIMD2
  Gene Name: LIM domain containing 2
  Uniprot ID: Q9BT23
  ENST ID: ENST00000578402
  CDS Start-End: 415-798
gccgcccgagggaccccgggccaggctccggggtcgccccggctgggtctctgcggccccacagctctgggcggggatgggggcgccggcgcctacgcgcgaggccaaccgggggaaaccgaggcagtgaatggcccaggccccgcccggttatcccggagccaggccgggagcgcccagtgtcccgcgaccgcagccgccgcagcctgaactcgtcccctcccagtaggatgcggagcgcggcccttccatcctgtccctgccaccgttgcttccccacgccgggccgccgtcgggatgggcagacggcgcggccggctggggccgggctggcggggccctcccgactgacttccccttgcagaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatcca

SEQ ID NO: 149189 - DNA, 1298 bp, Homo sapiens
  Payload ID: 9455
  Gene Symbol: LIMD2
  Gene Name: LIM domain containing 2
  ENST ID: ENST00000583211
  CDS Start-End: 343-579
gctcggggaccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatggcctcccggagctgcccctgccctgaccgcccctctccctcaggacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaac

SEQ ID NO: 149190 - DNA, 846 bp, Homo sapiens
  Payload ID: 9455
  Gene Symbol: LIMD2
  Gene Name: LIM domain containing 2
  ENST ID: ENST00000580222
  CDS Start-End: 371-607
cggcagcagctcgcgcccgcgccctcctcgtacccgtgcgcccccggagaccgatcccgccccgcggcccaggccgggcctggctggggccgggctggcggggccctcccgactgacttccccttgcagaacccagcgggtgccgcttctccacccgaggcttccacctccaacgagccatgttccaggctgcaggagccgcccaggccaccccctctcatggcctcccggagctgcccctgccctgaccgcccctctccctcaggacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcac

SEQ ID NO: 149191 - DNA, 509 bp, Homo sapiens
  Payload ID: 9455
  Gene Symbol: LIMD2
  Gene Name: LIM domain containing 2
  ENST ID: ENST00000582055
  CDS Start-End: 199-435
ctgcggcgcgcccctgggccttgggctgatggctgcagccctgatccagggcctcccggagctgcccctgccctgaccgcccctctccctcaggacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagct

SEQ ID NO: 149192 - DNA, 566 bp, Homo sapiens
  Payload ID: 9455
  Gene Symbol: LIMD2
  Gene Name: LIM domain containing 2
  ENST ID: ENST00000584645
  CDS Start-End: 240-566
atttccggccaagccacgcagtccctggtgcccgggaaggcgccggcctcgccgccgctccaaagcgagtggccgtctctcgccggctgtgcctccggcctgctgtgcggctgcagggagggagcagctctgcggcccaagctctgtcacctcagctctctgggccgcggctcccacgtgagaaatgagaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaag

SEQ ID NO: 149193 - DNA, 756 bp, Homo sapiens
  Payload ID: 9455
  Gene Symbol: LIMD2
  Gene Name: LIM domain containing 2
  Uniprot ID: Q9BT23
  ENST ID: ENST00000578061
  CDS Start-End: 110-493
gagacccgctggcggggctcgcggcgtcggggtctggggtccggtcctcgcggggccagaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcacccc

SEQ ID NO: 149194 - DNA, 502 bp, Homo sapiens
  Payload ID: 9456
  Gene Symbol: LPP
  Gene Name: LIM domain containing preferred translocation partner in lipoma
  ENST ID: ENST00000414139
  CDS Start-End: 224-502
actttttgtctgtgggttcgttcccgggtcccgcgcgagctttcccgggataagtagctttagcgatcgggagacagccgggcgctgcaaggtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacct

SEQ ID NO: 149195 - DNA, 888 bp, Homo sapiens
  Payload ID: 9456
  Gene Symbol: LPP
  Gene Name: LIM domain containing preferred translocation partner in lipoma
  ENST ID: ENST00000415906
  CDS Start-End: 1-759
atggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttgaatgctgataatgccaagctgtgtttacagtccaaatttttgctgaagaccttcaactttgcactctccctgtgtggtatctcttgcccaagacagaacttcaaataaaatcacatagctgatgcaagaaaccgtta

SEQ ID NO: 149196 - DNA, 5835 bp, Homo sapiens
  Payload ID: 9456
  Gene Symbol: LPP
  Gene Name: LIM domain containing preferred translocation partner in lipoma
  ENST ID: ENST00000448637
  CDS Start-End: 147-1433
atttctcttccgagagcttcagtttcctcacgtgccaagcggacgggttggaagttggtctttgccagctctgacaccttcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacaga

SEQ ID NO: 149197 - DNA, 343 bp, Homo sapiens
  Payload ID: 9456
  Gene Symbol: LPP
  Gene Name: LIM domain containing preferred translocation partner in lipoma
  ENST ID: ENST00000454789
  CDS Start-End: 147-343
gtgggttcgttcccgggtcccgcgcgagctttcccgggataagtagctttagcgatcgggagacagccgggcgctgcaagcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtga

SEQ ID NO: 149198 - DNA, 386 bp, Homo sapiens
  Payload ID: 9456
  Gene Symbol: LPP
  Gene Name: LIM domain containing preferred translocation partner in lipoma
  ENST ID: ENST00000426274
  CDS Start-End: 188-386
aggaattgaagagaatcctgacaagtggcatgttgggaaaggcctgaaggaagccagaccagcttgctctcagagctccttgggtcccctgcggcccccaggtgatcttcagcaagacctgcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgatt

SEQ ID NO: 149199 - DNA, 521 bp, Homo sapiens
  Payload ID: 9456
  Gene Symbol: LPP
  Gene Name: LIM domain containing preferred translocation partner in lipoma
  ENST ID: ENST00000430340
  CDS Start-End: 364-521
gaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaaggtgggaactttgaggctcagagacagagcagaagacagaacctggtcttctgattccctgtgttctgcttttttcattgttccactggacgctcatcagagggaagatctttttcctcaattgggacatggatgaacctggaaaccatcattctcagcaaactatcgcaaggacagaaaaccaaagaccgcatgttcttactcacagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacc

SEQ ID NO: 149200 - DNA, 479 bp, Homo sapiens
  Payload ID: 9456
  Gene Symbol: LPP
  Gene Name: LIM domain containing preferred translocation partner in lipoma
  ENST ID: ENST00000457242
  CDS Start-End: 309-479
gatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaaccca

SEQ ID NO: 149201 - DNA, 400 bp, Homo sapiens
  Payload ID: 9456
  Gene Symbol: LPP
  Gene Name: LIM domain containing preferred translocation partner in lipoma
  ENST ID: ENST00000443217
  CDS Start-End: 261-400
aatgtctcagttctgttcccttcaggcttcgagaccaccgccttgctgtgtcccgtagtggactgagggcctgcaagagggagtgagggctagtggagggccagctgcctgtgggggctggacatcgtgtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgcccc

SEQ ID NO: 149202 - DNA, 535 bp, Homo sapiens
  Payload ID: 9456
  Gene Symbol: LPP
  Gene Name: LIM domain containing preferred translocation partner in lipoma
  ENST ID: ENST00000420410
  CDS Start-End: 201-535
cccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgagga

SEQ ID NO: 149203 - DNA, 612 bp, Homo sapiens
  Payload ID: 9456
  Gene Symbol: LPP
  Gene Name: LIM domain containing preferred translocation partner in lipoma
  ENST ID: ENST00000416784
  CDS Start-End: 160-612
ggggaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctct

SEQ ID NO: 149204 - DNA, 18220 bp, Homo sapiens
  Payload ID: 9456
  Gene Symbol: LPP
  Gene Name: LIM domain containing preferred translocation partner in lipoma
  Uniprot ID: Q93052
  ENST ID: ENST00000617246
  CDS Start-End: 190-2028
gtgggaactttgaggctcagagacagagcagaagacagaacctggtcttctgattccctgtgttctgcttttttcattgttccactggacgctcatcagagggaagatctttttcctcaattgcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 149205 - DNA, 18277 bp, Homo sapiens
  Payload ID: 9456
  Gene Symbol: LPP
  Gene Name: LIM domain containing preferred translocation partner in lipoma
  ENST ID: ENST00000618621
  CDS Start-End: 313-2085
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 149206 - DNA, 3219 bp, Homo sapiens
  Payload ID: 9457
  Gene Symbol: LIMK1
  Gene Name: LIM domain kinase 1
  Uniprot ID: P53667
  ENST ID: ENST00000336180
  CDS Start-End: 52-1995
cccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 149207 - DNA, 3360 bp, Homo sapiens
  Payload ID: 9457
  Gene Symbol: LIMK1
  Gene Name: LIM domain kinase 1
  ENST ID: ENST00000418310
  CDS Start-End: 103-2136
actgggttcacgtgggcacgtggctccactccggtcactgcttcctgggcagagggatgacgtggaaggtagacctaggggggacagggttgcttcctgcccatgtccagcattctagaattgtccacatctaggcagggcgttccaccatcagtgctggactggaccacccaattcctttggacgcttgactcagcccaaacccgtgctccctccaggaccctgggcagggcagccccagctccaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 149208 - DNA, 1883 bp, Homo sapiens
  Payload ID: 9457
  Gene Symbol: LIMK1
  Gene Name: LIM domain kinase 1
  Uniprot ID: P53667
  ENST ID: ENST00000435201
  CDS Start-End: 1-918
atgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactga

SEQ ID NO: 149209 - DNA, 2170 bp, Homo sapiens
  Payload ID: 9457
  Gene Symbol: LIMK1
  Gene Name: LIM domain kinase 1
  Uniprot ID: P53667
  ENST ID: ENST00000538333
  CDS Start-End: 172-2013
aagtcccctggcacccacgcggctgcagcctcctcctgtgcgctgcagccacgctggccccaccctctgcagcctccaatcctgagcccctgagggaggatggggaagcagctggtctggccacccctgccctcccttagacctccagagcccccagtgtagccacagaggatgctgttggcttcagccccaagaagacgccgcttcctccagagggctaagtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcc

SEQ ID NO: 149210 - DNA, 3462 bp, Homo sapiens
  Payload ID: 9458
  Gene Symbol: LIMK2
  Gene Name: LIM domain kinase 2
  Uniprot ID: P53671
  ENST ID: ENST00000333611
  CDS Start-End: 316-2169
ctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaa

SEQ ID NO: 149211 - DNA, 3670 bp, Homo sapiens
  Payload ID: 9458
  Gene Symbol: LIMK2
  Gene Name: LIM domain kinase 2
  Uniprot ID: P53671
  ENST ID: ENST00000331728
  CDS Start-End: 115-2031
gtggtcttcccgcgcctgaggcggcggcggcaggagctgaggggagttgtagggaactgaggggagctgctgtgtcccccgcctcctcctccccatttccgcgctcccgggaccatgtccgcgctggcgggtgaagatgtctggaggtgtccaggctgtggggaccacattgctccaagccagatatggtacaggactgtcaacgaaacctggcacggctcttgcttccggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggcaa

SEQ ID NO: 149212 - DNA, 2789 bp, Homo sapiens
  Payload ID: 9458
  Gene Symbol: LIMK2
  Gene Name: LIM domain kinase 2
  Uniprot ID: P53671
  ENST ID: ENST00000340552
  CDS Start-End: 231-2291
gggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagta

SEQ ID NO: 149213 - DNA, 2657 bp, Homo sapiens
  Payload ID: 9458
  Gene Symbol: LIMK2
  Gene Name: LIM domain kinase 2
  ENST ID: ENST00000406516
  CDS Start-End: 270-2159
atcccgttcgcgcctggggctgtggtcttcccgcgcctgaggcggcggcggcaggagctgaggggagttgtagggaactgaggggagctgctgtgtcccccgcctcctcctccccatttccgcgctcccgggaccatgtccgcgctggcgggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctcctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagagccccccccggggccgcaggagagggcccgggctgcgcggatgatgagggcccagtgaggcgccaagggaaggtcaccatcaagtatgaccccaaggagctacggaagcacctcaacctagaggagtggatcctggagcagctcacgcgcctctacgactgccaggaagaggagatctcagaactagagattgacgtggatgagctcctggacatggagagtgacgatgcctgggcttccagggtcaaggagctgctggttgactgttacaaacccacagaggccttcatctctggcctgctggacaagatccgggccatgcagaagctgagcacaccccagaagaagtgagggtccccgacccaggcgaacggtggctcccataggacaatcgctaccccccgacctcgtagcaacagcaataccgggggaccctgcggccaggcctggttccatgagcagggctcctcgtgcccctggcccaggggtctcttcccctgccccctcagttttccacttttggatttttttattgttattaaactgatgggactttgtgtttttatattgactctgcggcacgggccctttaataaagcgaggtagggtacgcctttggtgcagctcaaaaaaaaaaaaaaaaatgatttccagcggtccacattagagttgaaattttctggtgggagaatctataccttgttcctttataggccaaggaccgcagtccttcagtaacaccagtgtaaaagcttgaggagaaattgtgaagctacacagtatttgttttctaatacctcttgtcattctaaatatctttaatttattaaaaaatatatatatacagta

SEQ ID NO: 149214 - DNA, 606 bp, Homo sapiens
  Payload ID: 9458
  Gene Symbol: LIMK2
  Gene Name: LIM domain kinase 2
  ENST ID: ENST00000425203
  CDS Start-End: 360-606
aacttgacagcagcgcttctttcttagctagtcaccggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtgagtgaatcccttcatatctgcccctcttggtcttcagagtccattgacagtgctt

SEQ ID NO: 149215 - DNA, 1279 bp, Homo sapiens
  Payload ID: 9459
  Gene Symbol: LMO1
  Gene Name: LIM domain only 1 (rhombotin 1)
  Uniprot ID: P25800
  ENST ID: ENST00000335790
  CDS Start-End: 497-967
agcgggagacggccacgagattcccccatctctttgaatataattttagattgagattcagattaaatccgaggggaaaacactttatgaggctgaaagctgtgtcgttgccagagacagggttatgagctatcaaatgcaattacattaagacagattatactgggcaaattgagccatttagaaggtgagaatcaaagaaacggctctgatcctcttttcccccttctctctccctctccctctctctctaaattgcagttcgtagttccttccaattctgaggcacaaaagtaggtgagactgcttttgtatctgcgaagtgcttcactcctgaatgtaattctagctgagtgcaatctaggttaagagccggacaagcgggtaattagagcccgctagctgcccgaagaccggccgcccctccaaagcgcgccccgagtcggcgcccttctcccggccgagcctagctgcggctggacacggagcgcccgagatgatggtgctggacaaggaggacggcgtgccgatgctctccgtccagcccaaagggaagcagaagggctgtgcgggctgtaaccgcaagatcaaggaccgctatctgctgaaggcattggacaagtactggcacgaagactgcctcaagtgtgcctgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtttccgggaggtta

SEQ ID NO: 149216 - DNA, 1038 bp, Homo sapiens
  Payload ID: 9459
  Gene Symbol: LMO1
  Gene Name: LIM domain only 1 (rhombotin 1)
  Uniprot ID: P25800
  ENST ID: ENST00000428101
  CDS Start-End: 269-736
gcccgggcagctgctgctcgcgaggctcccgcgatcccggcctggccgtctcgcccccgcgccttccccccagtccctcctcctgcgctccctgcccgcggggctgcgctccggactccggtccgtctgcccccgtcggcggtcgcggctctccggactcggcgcccgcgcggggccggcgggagcagcgcaggcggccggcggcgggagtcggagccacgcgcccctccgtatcctcggcgctagtccggctggagccgtcgggaccatggtgttggaccaggaggacggcgtgccgatgctctccgtccagcccaaagggaagcagaagggctgtgcgggctgtaaccgcaagatcaaggaccgctatctgctgaaggcattggacaagtactggcacgaagactgcctcaagtgtgcctgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtttc

SEQ ID NO: 149217 - DNA, 770 bp, Homo sapiens
  Payload ID: 9459
  Gene Symbol: LMO1
  Gene Name: LIM domain only 1 (rhombotin 1)
  ENST ID: ENST00000534484
  CDS Start-End: 196-633
agcgggagacggccacgagattcccccatctctttgaatataattttagattgagattcagattaaatccgaggggaaaacactttatgaggctgaaagctgtgtcgttgccagagacagggttatgagctatcaaatgcaattacattaagacagattatactgggcaaattgagccatttagaaggcgtgccgatgctctccgtccagcccaaagggaagcagaagggctgtgcgggctgtaaccgcaagatcaaggaccgctatctgctgaaggcattggacaagtactggcacgaagactgcctcaagtgtgcctgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgg

SEQ ID NO: 149218 - DNA, 2294 bp, Homo sapiens
  Payload ID: 9460
  Gene Symbol: LMO2
  Gene Name: LIM domain only 2 (rhombotin-like 1)
  Uniprot ID: P25791
  ENST ID: ENST00000257818
  CDS Start-End: 831-1514
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaaggtgcgaggggctccgggcggccgggcgggcgcacaccatccccgcgggcggcgcggagccggcgacagcgcgcgagagggaccgggcggtggcggcggcgggaccgggatggaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 149219 - DNA, 1687 bp, Homo sapiens
  Payload ID: 9460
  Gene Symbol: LMO2
  Gene Name: LIM domain only 2 (rhombotin-like 1)
  Uniprot ID: P25791
  ENST ID: ENST00000395833
  CDS Start-End: 431-907
ggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 149220 - DNA, 1519 bp, Homo sapiens
  Payload ID: 9460
  Gene Symbol: LMO2
  Gene Name: LIM domain only 2 (rhombotin-like 1)
  Uniprot ID: P25791
  ENST ID: ENST00000411482
  CDS Start-End: 151-318
cgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagagtcactgaaaggcagtcaggtgagatgccctgtctggcccaaaacgatctcggaccctcggtgctggtctcactctggtgaggctgtccctgatgcttggccttctctccagggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 149221 - DNA, 3810 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000261169
  CDS Start-End: 491-961
atatcctaatagattgagattcaaactgatgcagcacattttttacggggactactcagattgctgttatgaaatacaagtcagatttatgatctttttcatattgaacatgatatgctatgctaacgctgcatgtgacagtttaatcaaatccatttgttaccaggaagctaaaaggggccgctgggattttaggattacgggcagagttagggaagcatgtggctttgtcattcgccatcattttgcacactgcgaggggctccgtgtgtgcgccctgtcttgtctggccgtcctcatcccttcccccaccccctgccgccactccgacccgctcccaaagtggcttcacaatagtcggtcctcggcggtgtaggctgcgcaccaggtccacacttaagcgaaatcaaggagacccccttctacttctacctttgggtttggtgctcaatgcgaagctgctgcaactcagacacgcctaagtcaactcatgcagaaaaaggagaaaagttttggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 149222 - DNA, 3759 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000320122
  CDS Start-End: 524-961
atatcctaatagattgagattcaaactgatgcagcacattttttacggggactactcagattgctgttatgaaatacaagtcagatttatgatctttttcatattgaacatgatatgctatgctaacgctgcatgtgacagtttaatcaaatccatttgttaccaggaagctaaaaggggccgctgggattttaggattacgggcagagttagggaagcatgtggctttgtcattcgccatcattttgcacactgcgaggggctccgtgtgtgcgccctgtcttgtctggccgtcctcatcccttcccccaccccctgccgccactccgacccgctcccaaagtggcttcacaatagtcggtcctcggcggtgtaggctgcgcaccaggtccacacttaagcgaaatcaaggagacccccttctacttctacctttgggtttggtgctcaatgcgaagctgctgcaactcagacacgcctaagtcaactcatgcagaaaaaggagaaaagttttggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttca

SEQ ID NO: 149223 - DNA, 3574 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000354662
  CDS Start-End: 288-725
ttcttctcagtgcattggctgagacagagcgcacgagacacacacacatgcatgcacacatatgcacacacacacactcacacatactggggtgttttcagagtggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 149224 - DNA, 3534 bp, Homo sapiens
  Payload ID: 9461
  Gene Symbol: LMO3
  Gene Name: LIM domain only 3 (rhombotin-like 2)
  ENST ID: ENST00000396205
  CDS Start-End: 245-454
agcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggtaggaattatccttgcacaccagtgatgactggatgccttttaaagtacttttgctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttca

SEQ ID NO: 149225 - DNA, 2403 bp, Homo sapiens
  Payload ID: 9461
  Gene Symbol: LMO3
  Gene Name: LIM domain only 3 (rhombotin-like 2)
  ENST ID: ENST00000453727
  CDS Start-End: 178-360
gtgaccttttctttggctgtattatgtctggctgggaagggattgcattttgcagctgagagccggagcttccttcagctcggctcctcgcacgctgctggggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttcc

SEQ ID NO: 149226 - DNA, 983 bp, Homo sapiens
  Payload ID: 9461
  Gene Symbol: LMO3
  Gene Name: LIM domain only 3 (rhombotin-like 2)
  ENST ID: ENST00000424192
  CDS Start-End: 167-379
aaagaaagaaacagctgaaaacttgaagacgtgtttagaaatatacatatatacacactattttcttgtgggagatctcctttgggcaaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgagcatttgaagaggtgtggatctatatacatacatgctgcacatacagagattggaatctgtgtaaccttagaatggccattaccttttgtcatcattgactttagccaacaaatcaccatagcttggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtg

SEQ ID NO: 149227 - DNA, 3515 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000441439
  CDS Start-End: 276-713
acacatactggggtgttttcagagtggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattca

SEQ ID NO: 149228 - DNA, 3365 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000447609
  CDS Start-End: 127-564
gtcgactcctgcagaggtcacattttgtgtgcgggtttgtccccagcgtttgagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattc

SEQ ID NO: 149229 - DNA, 1489 bp, Homo sapiens
  Payload ID: 9461
  Gene Symbol: LMO3
  Gene Name: LIM domain only 3 (rhombotin-like 2)
  ENST ID: ENST00000541764
  CDS Start-End: 266-544
attctggtagcagtttgattctcttgcttttattttaatttccataattggtagcttcagaaatggctttggaaggcaatttgctttaaatgtagccacctattccaaaatgccctggttattttaggaaccctacccttttcctccggagctctctcgcaggagttcttcttttggactggtccaggaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgagtatctcaagtggatttatgttaccatttcaaataaggagtttatatagcccgggcaatgttaaggtgttttaataaaccaaaggacaaaaattaagtaaacttgaaagaatgtcaactgaaatatctggggtttttgaaaacaaaaataaaaatttgccaaggaaatacctatatttttaattggcttataaaaattggtttgtgtatatgattacttctgctgacacatggcacttcctcttgttaagcatttgaagaggtgtggatctatatacatacatgctgcacatacagagattggaatctgtgtaaccttagaatggccattaccttttgtcatcattgactttagccaacaaatcaccatagcttggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtata

SEQ ID NO: 149230 - DNA, 580 bp, Homo sapiens
  Payload ID: 9461
  Gene Symbol: LMO3
  Gene Name: LIM domain only 3 (rhombotin-like 2)
  ENST ID: ENST00000539232
  CDS Start-End: 298-480
aactttcactcgggctgcagctctactgagacggttttgtttaaatcatgtgaggcttcattatttttatgatgagacatgaaatagatgcaggcggaagatgttgatggaaggagggagagcggctgcggcgcggaacgtctcaagtacgactcgagtggataatagtcaaagttcaccatgaactgcagtatttccacacccctgactcccggggagagaggggcagggagagtttggaattaggaagtgtttgctcccagcccataggaaaagaattcagtcctgggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgtt

SEQ ID NO: 149231 - DNA, 1016 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000534946
  CDS Start-End: 232-669
tctgggacgccacagaaatcgtaactgaacacccgcacacaaaagtaatctgtgaggtgtgttttaaagaaagaaacagctgaaaacttgaagacgtgtttagaaatatacatatatacacactattttcttgtgggagatctcctttgggcaaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccat

SEQ ID NO: 149232 - DNA, 555 bp, Homo sapiens
  Payload ID: 9461
  Gene Symbol: LMO3
  Gene Name: LIM domain only 3 (rhombotin-like 2)
  ENST ID: ENST00000544754
  CDS Start-End: 74-283
gtacagaacaagtcaactaaggggttctcattaatctaccgtctgtgaatatcgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggtaggaattatccttgcacaccagtgatgactggatgccttttaaagtacttttgctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcacccca

SEQ ID NO: 149233 - DNA, 565 bp, Homo sapiens
  Payload ID: 9461
  Gene Symbol: LMO3
  Gene Name: LIM domain only 3 (rhombotin-like 2)
  ENST ID: ENST00000540590
  CDS Start-End: 313-565
agtatcaacctcatccttcccttgaccgagacctttcactgctcctggactttcagggtgtgctatcctttgcctccccccaacaacctgtctgctgccctaaaaaaaaaattaaaaaaaaaaaagacggcaacctaaccggagcatctctgggacgccacagaaatcgtaactgaacacccgcacacaaaagtaatctgtgaggtgtgttttaaagaaagaaacagctgaaaacttgaagacgtgtttagaaatatacatatatacacactattttcttgtgggagatctcctttgggcaaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatcc

SEQ ID NO: 149234 - DNA, 1685 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000537304
  CDS Start-End: 475-912
cgagaggtaaatagtcttaaatcggaagggagctgcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtcttttttttttttttcaaacaatgcttctttttgacctttcccaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttg

SEQ ID NO: 149235 - DNA, 587 bp, Homo sapiens
  Payload ID: 9461
  Gene Symbol: LMO3
  Gene Name: LIM domain only 3 (rhombotin-like 2)
  ENST ID: ENST00000536172
  CDS Start-End: 215-397
gaggaagggaggaagggaggaaggagagtgtgtgtgtgatcccctgaaccaggcttgtgtggcggacttgcggagcagcgacttcagagagttcatgaatggaagtcacagacagaccagcgactgcagccacctccaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggtt

SEQ ID NO: 149236 - DNA, 1499 bp, Homo sapiens
  Payload ID: 9461
  Gene Symbol: LMO3
  Gene Name: LIM domain only 3 (rhombotin-like 2)
  ENST ID: ENST00000541589
  CDS Start-End: 101-283
aaagccaaacttaagaaatctgcctatgtacagaacaagtcaactaaggggttctcattaatctaccgtctgtgaatatcgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaaga

SEQ ID NO: 149237 - DNA, 590 bp, Homo sapiens
  Payload ID: 9461
  Gene Symbol: LMO3
  Gene Name: LIM domain only 3 (rhombotin-like 2)
  ENST ID: ENST00000546279
  CDS Start-End: 259-590
ctctccttctctctctctctctcctccttgcttggcagtattacttgcttataagtgtgggggaaatggtaaaattgagaggaaaaggaagattggggaaaaaggaagaggatgggatgcacttagagatctgggtgtttgtcccttaagaaaaaggtgacaaagtggttaatgtctttgcaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagag

SEQ ID NO: 149238 - DNA, 496 bp, Homo sapiens
  Payload ID: 9461
  Gene Symbol: LMO3
  Gene Name: LIM domain only 3 (rhombotin-like 2)
  ENST ID: ENST00000546281
  CDS Start-End: 141-496
agtcctgaaaacatgtttctcagtgctgttggctgtttttcattggagcgtgtgagttttaaatagagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaattttt

SEQ ID NO: 149239 - DNA, 906 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000540445
  CDS Start-End: 226-729
gtgatcccctgaaccaggcttgtgtggcggacttgcggagcagcgacttcagagagttcatgaatggaagtcacagacagaccagcgactgcagccacctccaggcatttcttaaaggggagggttgtgtgctttttccagggtattctggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagagcatttgaagaggtgtggatctatatacatacatgctgcacatacagagattggaatctgtgtaaccttagaatggccattaccttttgtcatcattgactttagccaacaaatcaccatagcttggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttc

SEQ ID NO: 149240 - DNA, 543 bp, Homo sapiens
  Payload ID: 9461
  Gene Symbol: LMO3
  Gene Name: LIM domain only 3 (rhombotin-like 2)
  ENST ID: ENST00000539534
  CDS Start-End: 188-543
aatgcatgcacatttggtgttttgtatccttctacatgcaagtttaaaactttatgcctaggagagcaaacataatgcagcagaagggtctctggactgtaagaaggccatttggctggagtctatagcgtaactgtctttcagctttgagcaagtctctgaacctctcttgggcctcggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaattttt

SEQ ID NO: 149241 - DNA, 530 bp, Homo sapiens
  Payload ID: 9461
  Gene Symbol: LMO3
  Gene Name: LIM domain only 3 (rhombotin-like 2)
  ENST ID: ENST00000545436
  CDS Start-End: 267-530
atcatagatgcactttgctggcgctctgcactcctggccgctcaaaagcctttctgcttttccgctgcttttgtgtctttctgaaagaaccgaaatattattgttgtaactgctttgaaagactgctgcttaaaccaattaatcttgctagatgcaacaaatactgctacattctttgcaaaccatccctgtgtggctgcaaagacacaaccacaaaaggctggagcataaactccgcaagggattctttgttagagtgtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgag

SEQ ID NO: 149242 - DNA, 573 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000541846
  CDS Start-End: 96-533
gagaaaacacagctctgtcaatggactgaatgcaccattaaaactggcgtcactacaaaggttagagcagatctaactgtcaatacagtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacat

SEQ ID NO: 149243 - DNA, 516 bp, Homo sapiens
  Payload ID: 9461
  Gene Symbol: LMO3
  Gene Name: LIM domain only 3 (rhombotin-like 2)
  ENST ID: ENST00000537757
  CDS Start-End: 161-516
aatggtgcagaaactatggttctttgaccaagttagtcctgaaaacatgtttctcagtgctgttggctgtttttcattggagcgtgagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaattttt

SEQ ID NO: 149244 - DNA, 579 bp, Homo sapiens
  Payload ID: 9461
  Gene Symbol: LMO3
  Gene Name: LIM domain only 3 (rhombotin-like 2)
  ENST ID: ENST00000538051
  CDS Start-End: 288-579
ttcttctcagtgcattggctgagacagagcgcacgagacacacacacatgcatgcacacatatgcacacacacacactcacacatactggggtgttttcagagtggctgtagcagagaggtggggtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgttt

SEQ ID NO: 149245 - DNA, 1574 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000540848
  CDS Start-End: 114-551
agatctaactgtcaatacagtgagtagagtggagtccggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagattt

SEQ ID NO: 149246 - DNA, 622 bp, Homo sapiens
  Payload ID: 9461
  Gene Symbol: LMO3
  Gene Name: LIM domain only 3 (rhombotin-like 2)
  ENST ID: ENST00000538020
  CDS Start-End: 448-622
atcataagatatcagaggaaactggaggaggtttagctgttttggagaaggaaaatgtacaaaagtgcagattatagcttgacatttcttatcctataatgcatgcacatttggtgttttgtatccttctacatgcaagtttaaaactttatgcctaggagagcaaacataatgcagcagaagggtctctggactgtaagaaggccatttggctggagtctatagcgtaactgtctttcagctttgagcaagtctctgaacctctcttgggcctcggtaacataatttgtaaaatgagggaatttggaattgatgatgtctgcagtactttatagtgcttaaaatgagttatttgataaatatgaggcattggatagttggtccagcttcttgctaaagctgggtgttttaatacctaggaaataagaagacactcaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagcta

SEQ ID NO: 149247 - DNA, 1488 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000535535
  CDS Start-End: 212-649
ttccccaacctctgctaatgaggcataaactggagctgcaacccagctccgcactgcaactttcactcgggctgcagctctactgagacggttttgtttaaatcatgtgaggcttcattatttttatgatgagacatgaaatagatgcaggcggaagatgttgatggaaggagggagagcggctgcggcgcggaacgtctcaagtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtg

SEQ ID NO: 149248 - DNA, 3498 bp, Homo sapiens
  Payload ID: 9461
  Gene Symbol: LMO3
  Gene Name: LIM domain only 3 (rhombotin-like 2)
  Uniprot ID: Q8TAP4
  ENST ID: ENST00000541295
  CDS Start-End: 158-649
ttccccaacctctgctaatgaggcataaactggagctgcaacccagctccgcactgcaactttcactcgggctgcagctctactgagacggttttgtttaaatcatgtgaggcttcattatttttatgatgagacatgaaatagatgcaggcggaagatgttgatggaaggagggagagcggctgcggcgcggaacgtctcaagtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 149249 - DNA, 3227 bp, Homo sapiens
  Payload ID: 9461
  Gene Symbol: LMO3
  Gene Name: LIM domain only 3 (rhombotin-like 2)
  ENST ID: ENST00000616247
  CDS Start-End: 1-378
atgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgctgggagaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 149250 - DNA, 1260 bp, Homo sapiens
  Payload ID: 9462
  Gene Symbol: LMO4
  Gene Name: LIM domain only 4
  Uniprot ID: P61968
  ENST ID: ENST00000370542
  CDS Start-End: 151-648
ggggctgggaggaggtgccgcgaggggtggagcgcgcagcggagcctgctctcggagttttgacagtaccggagctgaaattgtcagcggcggcaagcgcaggaaagttgagaggagctcgtggccccagaacaaagcttgagaaaaaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaa

SEQ ID NO: 149251 - DNA, 5405 bp, Homo sapiens
  Payload ID: 9462
  Gene Symbol: LMO4
  Gene Name: LIM domain only 4
  Uniprot ID: P61968
  ENST ID: ENST00000370544
  CDS Start-End: 781-1278
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggcccccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggttcctcaagcactgctgcgtatttaataatgagcttctaaaagcatttcttaagttgcagacctataagattacaaatgtcactcatgttagtataatccacatgcaagtgatgaagccttctctttgatgtgctaaattggagaaggactaatggagctatgaatatacaatagaacatatttaagtagtagtcttgctttaggtaaaacactttcttgaaaccagaggcatttcaaacaataaaacccggctctaatggggatgctctgtgtggatagaaagctactaaaaacactcaggtttattctgatgtgagcagcgattgtgtgcagttcctcccccaatctcaacattgcttaggaaaaaaaaaaatctatgagtttattccacctttcatccattgcatttgtgatgttattagttagcaagatggacactgttctttagaaaggacttatttaatattaaccacgtcatagagcaagatggcccccagtccctacaagcaagtgcaattaaaaataaaagcaaatgttactgagccctgctgaactcctgataaaaaaaattatgtttatggtacatataaatgtctcaatcatgcaaattgtcactcttgttaatgaaacaattttgtaaaaagatagtcctctaaaagggtttaatgttttttacctatctaactgtctaattagatttacacatcccgcaaggcaggggagcctgaagcttttccaaaccaaatcgtttgccactagaaactattttcagctcttcatgatttattaggaaatagtttaacccggactgtagtgtcttataaaatacaaaacgagaaaactgacacaccaaaatgaagtctgtgaaattgtcatcctcttaatattacctgtatttaaattctttcttttgcccttattaacactgatatttgaaacaactaatcatctaaaaggaagctcttaaagggctttaaatgtcaatatagtaagattctaatgtgcactactatttatataaaatatttcttagggcccataaatcatataataaacagtgaacccaagagctacatatggagtctagtgaagagttcccatgtagcctaactaattgtatttaaattgaggagatccaaaaaccccatcacccttcaccccaaagaccccttcacccttcaccagggaattctatcctgggtgctgtcccacctatgaccccttcaagaggccattggaaaaaggccatttacaagttaatgttacttatagctttgttactaagactcacctattgttagtgcagccaagtcacagaagtgcttattgcagttaaatagcaatttgtttccatgaaactgcaattaaagtattactgagcagccattttagattggcagtgctctgaacgcatgttaaacagccagctactcccacttgcagagtctgagatctgactagcagcaaagtgtagcacattcgccgatgctgggtacctagttaaagaggcatttgtagccctctgctcccatcgtgaacatgctgagagcaatgacaagtcagggctgatttttggaaggtgaacttgcaacttacctcaagtgaatactgttttcagttgtgcaagaagtgctttatgctagtagatatgtgcatgtttcctagagggaatgttttcaagttcagattgattctgctgagaatggacggcaactcggaggcctcaagccaataatgtactacaggccctgacatgttacagctgtgtaaacagggccattctatttcctaaatcacaactaataaagcagaggatgaaaatcaa

SEQ ID NO: 149252 - DNA, 11331 bp, Homo sapiens
  Payload ID: 9463
  Gene Symbol: LIMD1
  Gene Name: LIM domains containing 1
  Uniprot ID: Q9UGP4
  ENST ID: ENST00000273317
  CDS Start-End: 22-2052
gcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggaccccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggtctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgatttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctctgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttctttttttttttgagacagggcctcactctgttgcccaggctggagtgcagtggcgcgatctcagctcactgcagcctccacctactgggctcaagtgatcctcccacctcagcctcccgagtagccgggaccacaggcgtgtatgactggctacgcctggctaatttttgtatttttaatagagacgagtttcaccatgttgcccaggatggtctggaactcctgggctcaagtgatctgcccacttccgcctcccaaagtgttgggattatggccattagccactgtacctggcacaatttttttttgtaccctcctttatgccaagaatcagtcctaatttctttactatgtgaagtaacttttaaaggtaatagaaaaggccaggcacagtggctcatgcctgtaatcccaggcgccgtggctcacgcctgtaatcccagcactttgagaggctgaggcgggtggatcacttaaggtcaggagttagagaccagcctgaccaacatggtgaaacactgtctctactaaaaatacaaaattagctgggtttggtggcgcacgcctgtaatcccagctacctgagaggttgaggcaggagaatcgcttgaacctgggaggcagaggttgcagtgagccgagatggtgccattgcactccgacctgggcaacagagcgaaacactgtctcaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatatttcctgggtcttttctgtgtgtggagtcagcaaactgttttttgctacctggactttgtcttcttttacagctctggattcttaaaagtaccacataggtagcaaacctgtgaagggtatgagattttaccctacttgcaggctaataaagtgagcacaccacatgggttcatggatcctggcagaagttatgagactcataggtcagagacaaaggacagtttattatagcaatagcagtggccagattatcagcatttacactggttccctgagccccaggccccaagaagagggccaggtgagacctgcacacgcagtgggctgcattacaagaggaacccccatgcttaggggaccctggtatttgataatgggcagtaagcctgcctgacttttgctccagagacagacactatctctgtcatccaagactgttcactagataaacatccttgaaaatataagtctggaacctggcaattggtgtctattcttaccagatgtataaaaatgtgagaggccttggagaatcatatcccaagaatcagcagtttcttttactggacctttaagattgagacttgtaaggtcctgatgcagtgacttgtaaggtcactttgtctctcttgtgaatgttactgttttttctcttctgaggttatgaccaaagaatcctcaaggcgagtgatccttcaggtttgagacagccacatgcaggaagacaggacttgtagagtgttggggccaagtgtgtggttagaatccttggggtggggaaagagtttgttctagactccagtgtagtccttgtggctaccaggtctgacgtgccaaggacacgggaaagctgggagtgaggatactcatagtcatagcaccttacaccagaataaaagttttttttttctttttaagtgatgagagaatggctagtctgattttgccaacatgggctgctatttgcttaagaccttgatggtataaggagtgaagatgcaatcagggtaaaaggcggtctggagttgtggtgtgctggcaaaccagccctctggggcaaaaaattaaaaagccttgatatggagtgtttgctgatacctatgatgtaaatattcccgccatggccactttccagctaccagcaaggcatcctggcaccagggattgggaggagatggcatagtcctaagagtcagccttgggcattgggccatgtgggactgggcagtggggtatctggtctggttctaagtgctgtgatgaagcagtagcagctgtaatagctggcatttcccgtgtgctcatcacatagcagatgttattccaaggactgtatgttctttatcatccctcatttgatagacaagacaactgagacacaaaagggtgaaataaacagtaagtactccatcccaggccatctcatccagagggtgctgtcttgaccactctactactctggttgatgggaggcagtaaattgtccatcagtatacttcttcatcaaagctacatagtcaaaaagccacaggaggctgtgaggagaagctcactgctgctctgttgaagtctgtattggtttcctatggccactcttaacaaattaccacaacctcagtggcttaaaacaacacaaatatatcattctgtcatcctggacacgagccaaaggttgtcggcagaagcgaattgcttccagaggtgctatagggtgctgcccattccttgccccttttccgcttctagaggctgcccattttccttggcttgtggctgcatcattctggctgcttctattgtcacacctcctctctgaccctccctgcctccttgtaaggacacttgggattacgcccatccagataatctagaataatctcccattttgtgattcttaataacatctgcaaagcctcttttaccttgcagaataagatattcacaggttctggtgaggaggacagggacatctctgaaggggagggaagcaggagatagggtctggaggcatggaattggcttcctaaggccaattcaggctgacttcctagaactaagtcaaaaggaaaaccccaactttccacgctcaagtaacaaaaggaccagaggctactccctttgcaacctccccacccccagccccttttctgcatggcaggtgaaaaattgaaagtatcgctaattgatcccctcccacaaccaatcagactggtcttaggccaagtcttcatttgcctaggagtataactttgtaacttcagcctctgattgggcgttttacacaaccagtcagatgtttgtatagggtggtgtaactttgtaactttgcttcagcctctgattggtcccctcccacaaccaatcaaactgatcatggacctctgcttcatttacatagggtgtacaccaagtaaccaatgggaaacctctagagggtatttaaatcccagaaaattctgtaaccgggttcttgagctgcttgggctgctcccaccctgtggagcgtactttcgtttttcaataaatctcttttgttgcttcattctttacttgctttgtgcgttttgtccatttctttatcaagacgccaagaacctggacaccctccaccggtaacaggaggagcattagtcagcctaccacagactccaacgaacgttttttgagaggaaatgaaagaatattcctaagttattgggtgccttttcttcaggaatccctgaaagtgggggtttgcaattttccctggattgaaaacagaaatgcttcctacacaaacatgattgagaccttgtactctaggtgtaaaaaaacagagtaggtcatactctgtgggttatggtcagagagatctggttagaagttcccaggtaggcgacagccctagatgtgtgacacttctaggagaatctctggctatgtggatacgtccaggtgtgtaaggcagcctcagggactgccaccacttggtcacatacatgtccctccaactaatcctagctctcaaggacaggtggttctgggccctgtgttgcccatgagacttggtccacggcaagcctgtgacggagtgaaagtgaggggacacccaatttgaaaactcggcaggaagccagactccatgacatacaaatagatcaaagtgaatcggctccgttgtttggggaaatacctgaggtttgttgtttcgtgccaagaagattaacaacacggacacacgtgggtgggttaaggagcagaaagtttaacaggcagaaaaaagagaacagctcccccatgcagagggaggaggactccgaatggatctccccattcctggcgggaagcagactgatatatagaggagggggtttgaagaggtggtatttgatttacatagagcccaagggattggtttgaccaggtgtgccatttacatagccctcgaagaaactggccattccaccttgatcttttattatgcagatagggttttttacttggccagagccttgacacctgcacacatggcaacaaacagaagggaggcgaaatcttccatattggatgcacctgtcttccaggtgcagctgccggcatttatctgtgcaagcttctagcttgcttatttatgcttgcagcttgacttttcaggctgctttctgttggaaaagaaatggttttgggggctgctttttattaaaagaaaagccttaccaaggactcctgtaccctatctgcctaaattttttttaactactatattaaaaggtctgtaagtgggagctggccctaaaagtaggttgtagagattatttggatgtgccaacaagcttcatctgcagcttggactgtctccattggaaggcctctggcagattttgtaaaaagttatataacaattttactataggaaaaacttggctacagatatgaatttatattacccatcattggctggttccttatcctgaacattggtttccttggaatctgattttggcttgtttggcctttaaaaaccccagaagaatggggtttctgccagattattttctggttttcagtctcactgaatgtcacaaaggccttggtttatggttcccaactggtaaagaaacgtcaaactttgcctctcttagttccttctacatgacaatgggtggcagttgctcatatggaagcatttcttttccccctaaagcctatgagacaggctgcaacttaaacccctattttattaaaggagaggaaatgtccaagagcccagagatagtgggtaaaagcatcataaggactagaaatggggtcttcttgttgctaattagtaggggtgaggggtaagtggcagatgtgactgccgtccatgcccagacagggaattgtccttgaacctactcatgcggtgtcttctggggtacagtgagtccacagggcaggacggccttggagtcaagagcccagactcacattctatctcaggcttcataactcaattgctccatgaccttaagccaatttagttccctcatctgtaaaaatggggataacaactgaatttacctcatgggattgtgtaatgcccaaccttgtttttactaaccctgtttttagactctccctcttcctttaatcacctagccttgtttccacctgaattgactctcccttagctaagacagccagacagactccatcttggctctttcactggcaccccttcctcaaggacttaacttgtgcaagctgactcccagcacatccaagaatgcaattaactgataagatactgtggcaagctatatccgcaattcccaggaattcgtctgattgataacgcccaaagccccgggtctatcaccttgtaatagtcttaaagcccctgcacctggaactgtttactttcctgtaaccatttatccttttaactttttgcctactttatttctgtaaaattgttttaactagacccccccctcccctttctaaaccaaagtataaaagaaaatctagccctttcctcagggctgagaaaattttgagtgttagccgtctctcggtcgctggctaataaaggactcttaattcgtctt

SEQ ID NO: 149253 - DNA, 2773 bp, Homo sapiens
  Payload ID: 9463
  Gene Symbol: LIMD1
  Gene Name: LIM domains containing 1
  ENST ID: ENST00000440097
  CDS Start-End: 557-2419
gcagcggaggacccagcgcctggaacgtacctgcgcctcagccgccgcgcgtttgctccggcccgactcgcggcctcggcgccctcccggccgattcagcttcacccggcccagtcggctgctgccttgctgtgagtttccgtgtttggttgcctaaggaggatgtgattttacttttttgctgttttctttttccttttataatttgaagaggagaaaagaactccgctgagcaggcccgggacggcgaagtgccaccagctaccccaacaaggacgtctccaggggaaagggagttggaagcaaacttggtccagctggcgttgaggtctcaacttcggctggactcttaaatcctggggtcatgcccttcacgctaggcaggtggaagtctttacttgtactgggccggacttgagccccgacccttcgccagcatctccccgctgccctcaacacacacacacacacacacacacacacacacacacacacacacacacacacacacacacacacacggcacctgggctaggcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggaccccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggtctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgaggtaagatgcccttccagacatgctcccaggggcttctaagacatgaatatctccctgggctcatttacaagatccatgtcctgtccttacagcttttaaggtatccttttaaaaatctcaactctggcctggtgcagtggctcacgcctgtaatcccaccccttttaggaggcccaggcaggaaaattgcttgaggcctggagtttaagaacagcctgggcaacatagcaagacctcatctctacaaaaaattgttaaaaattggccaagtgtggtggcatgtgcctgtagtcctagctgcttgagcccaagagtttgaggctgcagcgagctatgatggtgctactgcattccagcaggtgacagcaagaccttgtctccaaaaaaaaaaaa

SEQ ID NO: 149254 - DNA, 3425 bp, Homo sapiens
  Payload ID: 9464
  Gene Symbol: LHX1
  Gene Name: LIM homeobox 1
  Uniprot ID: P48742
  ENST ID: ENST00000614239
  CDS Start-End: 724-1944
ccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggtaagatggtctccagccagaccgctcagtaaaatgacttgaacatcagctgtacaagaaaagtattctaccttcacacacaaaaagttaaaaaaaaaaaaaaagactattgaactaaaaacagtcaactgtttacgtataatgttaaattcaggagttcagtgttttactaatatatcctgttttgaaacctcttgttcgaaaacaaaatgttttgagcaatcaaccaaaattgttccttttcttttcctgtagatgttctgacagatttgcagggctttcggctcactgtgctagtatgtaaaaaggtgttgtttacacgaggcaaagagaaaacatgctattcagacagttgccaaatagaataattatagcacaaatactgtaaaggtgcctggcaccagcaacctgagaaagtgttaaaaaaaaaaaaaaaaaagtgttacaagatttaaaaaaaaacatctttgctaatttttttgtcctgttgaacattcatggaattgttaatatgacttatatagacccacacaggttttatttttgtgtctttaaaataaaagtccaaaatatttaaattttatggtcaaatatgcagtcaacagctgctactttttctttatatattaaatttctcatatgtcttttattgttctaataaacctaagcttgtgtgacctccagtgcatattagaccattcactgtatgaaagaaaacatgttgaataaatttgtgagtttttaataaaaatagaaaatctgatgttta

SEQ ID NO: 149255 - DNA, 512 bp, Homo sapiens
  Payload ID: 9464
  Gene Symbol: LHX1
  Gene Name: LIM homeobox 1
  ENST ID: ENST00000621767
  CDS Start-End: 1-424
gcggccgctggtggaccgcctggagccgggcgagctcatccccaatggtcccttctccttctacggagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtg

SEQ ID NO: 149256 - DNA, 3428 bp, Homo sapiens
  Payload ID: 9464
  Gene Symbol: LHX1
  Gene Name: LIM homeobox 1
  Uniprot ID: P48742
  ENST ID: ENST00000620305
  CDS Start-End: 724-1944
ccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcggccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggtaagatggtctccagccagaccgctcagtaaaatgacttgaacatcagctgtacaagaaaagtattctaccttcacacacaaaaagttaaaaaaaaaaaaaaaagactattgaactaaaaacagtcaactgtttacgtataatgttaaattcaggagttcagtgttttactaatatatcctgttttgaaacctcttgttcgaaaacaaaatgttttgagcaatcaaccaaaattgttccttttcttttcctgtagatgttctgacagatttgcagggctttcggctcactgtgctagtatgtaaaaaggtgttgtttacacgaggcaaagagaaaacatgctattcagacagttgccaaatagaataattatagcacaaatactgtaaaggtgcctggcaccagcaacctgagaaagtgttaaaaaaaaaaaaaaaaaagtgttacaagatttaaaaaaaaacatctttgctaatttttttgtcctgttgaacattcatggaattgttaatatgacttatatagacccacacaggttttatttttgtgtctttaaaataaaagtccaaaatatttaaattttatggtcaaatatgcagtcaacagctgctactttttctttatatattaaatttctcatatgtcttttattgttctaataaacctaagcttgtgtgacctccagtgcatattagaccattcactgtatgaaagaaaacatgttgaataaatttgtgagtttttaataaaaatagaaaatctgatgttta

SEQ ID NO: 149257 - DNA, 512 bp, Homo sapiens; identical to SEQ ID NO: 149255
  Payload ID: 9464
  Gene Symbol: LHX1
  Gene Name: LIM homeobox 1
  ENST ID: ENST00000633397
  CDS Start-End: 1-424

SEQ ID NO: 149258 - DNA, 2554 bp, Homo sapiens
  Payload ID: 9465
  Gene Symbol: LHX2
  Gene Name: LIM homeobox 2
  Uniprot ID: P50458
  ENST ID: ENST00000373615
  CDS Start-End: 740-1960
gactgcagagccggggctgggctaggcgcgcgcttggagagcattgcgcgcggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaagaaaaaaagaaaaaaaaaaaaggaaaaatcaaaccccctccaacggtcgctttgttgttttagaattttaaggtggaagtctgttcgaatatcagaatttgtaaaatctaaccagtaataaaaccacttattgaaacta

SEQ ID NO: 149259 - DNA, 1414 bp, Homo sapiens
  Payload ID: 9465
  Gene Symbol: LHX2
  Gene Name: LIM homeobox 2
  ENST ID: ENST00000446480
  CDS Start-End: 1-1237
ccacagtctgtcgggccccgaggtgcacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacagcccctccctccatggtccctacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccg

SEQ ID NO: 149260 - DNA, 471 bp, Homo sapiens
  Payload ID: 9465
  Gene Symbol: LHX2
  Gene Name: LIM homeobox 2
  ENST ID: ENST00000560961
  CDS Start-End: 32-471
gggactcccgagatgggaggttctgcagaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagc

SEQ ID NO: 149261 - DNA, 1266 bp, Homo sapiens
  Payload ID: 9465
  Gene Symbol: LHX2
  Gene Name: LIM homeobox 2
  ENST ID: ENST00000488674
  CDS Start-End: 1-347
ggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggcatctctctagatttatcttctgcctcccagactctcctggaagcaaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaagaaaaaaagaaaaaaaaaaaaggaaaaatcaaaccccctccaacggtcgctttgttgttttagaattttaaggtggaagtctgttcgaatatcagaatttgtaaaatctaaccagtaataaaaccacttattgaaacta

SEQ ID NO: 149262 - DNA, 2403 bp, Homo sapiens
  Payload ID: 9466
  Gene Symbol: LHX3
  Gene Name: LIM homeobox 3
  Uniprot ID: Q9UBR4
  ENST ID: ENST00000371746
  CDS Start-End: 120-1328
cgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcggacctgcgccgagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtcaa

SEQ ID NO: 149263 - DNA, 2365 bp, Homo sapiens
  Payload ID: 9466
  Gene Symbol: LHX3
  Gene Name: LIM homeobox 3
  Uniprot ID: Q9UBR4
  ENST ID: ENST00000371748
  CDS Start-End: 98-1291
gccccgcacgacgcggcgggacttgggagccccgaaccctccaggggacgctgacctaggaggagcgcgtctcgcgccactcggcctggtggccgcgatgctgctggaaacggggctcgagcgcgaccgagcgaggcccggggccgccgccgtctgcaccttgggcgggactcgggagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtca

SEQ ID NO: 149264 - DNA, 2698 bp, Homo sapiens
  Payload ID: 9466
  Gene Symbol: LHX3
  Gene Name: LIM homeobox 3
  ENST ID: ENST00000619587
  CDS Start-End: 465-1625
actgggagatgggctggagccggcggggtccacagccagggaggcgggtgcaatatgtcagtaaatcccggtcccttcagcgggcactcctctcttccagagactttttctaagtgaagagggagtcctcagcccttgacacctggaaaacccgctcacagactcgaggctcccacagggcacccttggacctccccagtgtggttcctccagggggcctgcagtaccgaagtggggtgtggggggcagaagcagcgggaagccagacgtttgagtaactctgacggtgttgggggcacccacgcctgacacaaaggcagtggatcggcttgtccagtccactcataagtaattttgcggctgcccaatgatggggaaggcattgatatttaccccggaggcctgcagacagggccaccaggcagggcagccacatttgcgaggagtccctagaaagagtggccatgacgcttaacatgaaggagacccgatggggtgccccagctccagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccgatgagccttccttggcggaaatgggcccggccaatggcctctacgggagcttgggggaacccacccaggccttgggccggccctcgggagccctgggcaacttctccctggagcatggaggcctggcaggcccagagcagtaccgagagctgcgtcccggcagcccctacggtgtccccccatcccccgccgccccgcagagcctccctggcccccagcccctcctctccagcctggtgtacccagacaccagcttgggccttgtgccctcgggagcccccggcgggcccccacccatgagggtgctggcagggaacggacccagttctgacctatccacggggagcagcgggggttaccccgacttccctgccagccccgcctcctggctggatgaggtagaccacgctcagttctgacccaggcccggctccaccctgcacctcacacgagggagctgcccctgggtgggcggctcggggctgctggggtttccgaggaagtggggccagggcgtcaagggagggctggtgccttcggagcctcccactgccgaccgcacagctccctctctgggggctgagggacccacctggcccctcctctgacacagggctggcccgccaggtggcctcccagcaagccagccttttttgtaagcaaatttctcccctttattgaccaattaactgagcacttgctgctatttctagacatgaaatgtcaccttgctgaggcccagcccagcccagcatagcccgagggctggaaaaacgctttcatctctaaaactgagaaatcatcataattgtgctttcacttcccaggctccatgtgtcttggagccgtcaccccgaggctccctctttaggtcggagattggccttgcctgtcgaggcaagaggctgcagaggcggggacacacctgtgtcctccgggagaggccccctcctctccccagaccacagggggcctctctgcctccagccccaccttccccgggagaagctttccccaatccccaggtctctagatcattctgttctcgagtatcctgtggaggaggcaaaaatgcctggcgccccttctctccaagctcaattctctaagcccctcagggtctcctcctcaccccaccccaggcccttggtgtccaggctgcacccacagatgtctgttgccaaacagcctgccctccctgccggagccggctctgccagccccagattgggaagtctccccgctggagaagggtggggctcctctgagcctgccctgcctcctccatcagatcctttgggaagaagtttctgggagatgcccgcagctgtgcgtgccccagacacaaaggctggcctgtgtgtaagtcaaagtcactcccgcaaacctgaatctcgagctacctattggttctgtgaatgttctgtgtcttttatttattctcgggtgatcagctctttccaagacttcaataaatttgtcagttacagtc

SEQ ID NO: 149265 - DNA, 5820 bp, Homo sapiens
  Payload ID: 9467
  Gene Symbol: LHX4
  Gene Name: LIM homeobox 4
  Uniprot ID: Q969G2
  ENST ID: ENST00000263726
  CDS Start-End: 245-1417
aacctgggatgtgcaccaaccccggagagcgagatcaaagggactggaaacagactggggactggcggggggagggggccggccagcctgtggagtcctccctgagaagcggagggcccggcttccaccgtgactccagcggcctgcttggggttttaattattattttgaaatttctgaatcgagctagagcgagagagcgagagatctccgtagactgcgactcgctggctttcgctccgagatgatgcagagtgcgactgtccccgcggaaggggctgtcaaggggctcccggagatgctaggtgtgccgatgcaacagattccccagtgcgctggctgcaaccagcacatcctggacaagttcatcctgaaggtcctggacagacactggcacagctcctgcctcaagtgtgcagactgccagatgcagctggcggacaggtgcttctccagggctgggagcgtctactgcaaggaggacttcttcaagcgcttcggcacaaaatgcacggcctgccagcagggtatccccccaacccaggtggtccgcaaggcccaggactttgtctaccacctgcactgctttgcttgcatcatctgcaaccggcagctggccacgggggacgaattctacctcatggaggacgggcggctggtgtgcaaggaagactacgagacagccaagcagaacgatgactcagaggctggagctaagcggccccggaccaccatcacagccaagcagctggagacattaaagaatgcatacaagaactcccccaagcctgcccggcacgtgagggagcagctgtcctcagagacaggcctggacatgagggtcgtacaggtttggtttcagaacagaagggccaaagagaaacgcctgaagaaggatgcagggcggcaccgctgggggcagttctataagagcgtcaagaggagccggggcagcagcaagcaggagaaggagagctctgcagaggactgtggggttagtgacagtgagctgagcttccgagaggatcaaattctctcagaacttggccacaccaataggatttatggcaacgtgggggacgttacaggcggacagttaatgaatgggagcttctccatggacgggacaggacaatcctatcaggacttgagggatgggagcccctatggaatcccccagtctccatcctccatatcgtccctgccatcccacgctcctttgctcaatgggctggattacacggtggacagtaatttgggcatcattgcgcatgcagggcagggagtaagccagacgctgagagccatggctgggggacccacctctgacatctccacaggaagcagtgtaggctatcccgactttccaactagcccaggctcttggctcgatgaaatggatcatcctcctttttaaacttctctcctccccaccctacctgcccccctggcttgagagaatatcttcaaggatcaaaagagacttgccttttaaggatcgaaagtacgccaatgtgaatttccattattttcaatggaagtcctccgctgattcctagaaggctgtgagaccacactagggcattgtttccctggggaagcagtgggagagcagactcatctcagaacacagcacagggggtaatggcctagagctctagggacactggcttgttgggtctctcccctgctgttctgcttaggggcttggctgctcagtgctttggtagcacaaggtgactgtgataggcccccttggcctttgggaactttgctccaactggtgtgtctcacacaatgcctcccaaaacactgctctcaccagaactgagactcctaaggtagaggcctcacagcccttgagtaaaataaaagtgatttctggaccatccttattgaaccctatatttcaaaatgaaaagatcagttattaaaggtcagtgaacactttgatggccagtttgatattaaaaacatgccccctccttttttatttttgctgtgaagatatgaattctttcctacaaaccagagaatatgaacctgttttggtttttaagtgtcccatctatatcattgactctgatggcaagaggtggttttcattgcaggtgactgaggctgagctgagtagccctggaccaccgctgcagattgcctgagtcgtccccttggtgcacagtgtgccttcttcaattgcttgtatcatttattccacaagacaggctgtgggctgtaaaatgagcaaaactaaaatgtggggagaacaaaatgacaatcaatcagtgaacatttgtagacacatttggattccaaacctgcagtctgttcagccatatcggctgatgccagtcttccagagttccccatcccttgtagggtgaaatatttggagtctgttttgaaggagttggtttagatgagcttgcaagtctacccctctgaaagctttctctgctgtcctagctgactcaattggaggacagttttggtcatttccaggaaccagcaatttttttttggcctaccttggttgggaagagtaatttagggagcagccctaaaattgtccaaagggttctaagtggttcttgggctgcatctctctggattgctggctggacacctgccatgccttgggctgcagtcccatggtcagaaagccagaactctctggccagtggtggtgcagggactccccgttgtgcaggtttgcagtagcaaatcactaagcctgaggccagagcaaggccaacccccgctttacgagttgccactcctgcgacagactgcactgctgtgggaaacgctgtcctgaatggtgctgcagctcccacccaccttgtgcacccatctaccatcaggaagctctccatgtgcaaactggaatttagccagctggaatttattcctgtccctctgggaagctgtgtttgcttcttctggcctcccattctcttaaatgagatcagcagagtaggaaagggtgagaaggcattgcctatcacatgaagtgatggggccagagaccctaaggacccttccttctacgaatggttggtcaccttttgaggactgcaaagacttaggcatgtcataggcagactaaaggaagaatacacagttcctcttggactgctacatcttttgtaagcccttttccaggactaaactaagttcaattaagtaagttctttaaaacagtaaattccgggatcagccttcgggccctcttctctgaccaattttatagcgtaccctcgttttttggtgtgctgcagtggtcatgatttttgcttgagaagtctgcaaacatagacacttctcttgaggttccatgtttatggatgatgttgtgttaatcctagccaattctgtgctattgggaattctccaatcatgaacactggggtggggaggaagacacaaatgccatgtgaggaaaggaaaatgcagtcgtctttttggaggatggctttttaaatacacccttcttagcaggctgcttaaaatacacaggagaaaaggctctgctgggcaatgaaccagatgaaaagctgcccacccagatcactgttgcaggttgactatttggcttagcaactcatgggatttcagaggcccttgaagtttttggtgagtatagtgtgggggagagcaggctttttaaaaggggggggggcatcctcctctgtgtagcactgtttaagatcactgtaagtaagttgaccagtttttgtaagttaatcatactaattcccagttcaatagtggaaggagaggccttcctcatttatactaataatataataaatctcttgaggaactcagtgagcagttgacgaggtcaatagttctttggcatcagtagggctggttagctggaaaaacccttgagagcactggcctgaaaaccaggagagctttgttttccagagccacctccccagaaagcagcaaacactgctgcctgtttagaagcacagccacagtaggtctaagattttaaatggatctccctacaggttgggttagcattatgggtgggctggtgccactaatgagccattgcatgacaggactcttctggggtttggaaatggagaaaagccgggcattcattacttttagcttctcttagaggcactcctctgttgcttggaagtctattatggggtataaggtgctacatggtagctgtttccccccttgctaaaatgacatggatgaattttaaaaatgaaatgagaccttctagaggcaaccattatctgcagtgcctggctggtcgactttagagtaggaagctcttgaatccaggagcaaattagttaaaaccccaagttccagtggtaactggtataagcaaaatggaaactgaggggctatggaggaatctctgtttgttggaacgtaatgaaaccatggaggaaataccagatttaagggctaagaagctggcccgatgggtaaatcagtgttgggagtcaggttcttggcccttcaaggacttgctatgcaacctcaggcaaattcctctcagtctttgtgctttctctttcttgtctcatctgacagttatgaatataacgtaaaataaagatcaactatcattgataacactgttcctgcaaatgaatactgtgaaacatcagggaaagaggaaaaaattaagccacaagaaaaccatttggcagtgtccttaaactttttttgggggggggcagtgtaaaacatgaaacctagtaagataattgggccattagatcttcatcattaaactcactttgcaaggaagtgtaagaaatctgtaaaacaaaagacattcctatctcagaagctcaaactggtgatttccaactgcctctttacaggagggggctcaaggcttctgatgagcaaaggctgtgtgttgtatgacagtccactctctgcacctacacttccacgtgccacgactgacaacttggttataaccatgaaaataatgaccatacctccccagccagcagggtctggaaggcctgaggaggctcatttttaaacactgcactttaaaaattggaaaccgtgagatgaagaaaaattcaattaagcggaaatgagttttgttttattgcctgctgctgaagggctctgggcatgctgaaagctaaatgaaaagcacatcactggctctcttctttcttggattggtcaattggccctttttgcagtagttgctccaactgttctaaacagtgagtgactggagccaaaaagagagagctcagcaaagccatcccatccacactctgcttggtaggaccacactaaaagcacagtttcatgctgctagctctggtaaggagacagctgcaggtttgggaggtgcaccaagcattcctttgcttagggaggcagagcacaggtgaacagaggaaggacacccccactctcatctattgcccaccgagaggcaagaatcacaccaactttcccacttgaggactgtgttcggccaaacaagcaggttcagggctgcgggattccagaagttgctctgagcttgcaatcagacctcaaagccccagatcccctcagctctggatcgttgccctcatccttcacaatgtaaattttgtacagttaaagagaaatgaagtctcgtttcctggggaaaaaaaagaaaaaaagaaaaaaaaaagacccacccatccttatttattgccatatgactttggaaaacagaagctggtgcgtttgtttgtatatgcctcctgtgtgttggcatgagatgtgtacggtaaaattatgtaaaataaatatggaaattcttta

SEQ ID NO: 149266 - DNA, 603 bp, Homo sapiens
  Payload ID: 9467
  Gene Symbol: LHX4
  Gene Name: LIM homeobox 4
  ENST ID: ENST00000561113
  CDS Start-End: 1-454
agattccccagtgcgctggctgcaaccagcacatcctggacaagttcatcctgaaggtcctggacagacactggcacagctcctgcctcaagtgtgcagactgccagatgcagctggcggacaggtgcttctccagggctgggagcgtctactgcaaggaggacttcttcaagtaagtcagaacggcgcttcggcacaaaatgcacggcctgccagcagggtatccccccaacccaggtggtccgcaaggcccaggactttgtctaccacctgcactgctttgcttgcatcatctgcaaccggcagctggccacgggggacgaattctacctcatggaggacgggcggctggtgtgcaaggaagactacgagacagccaagcagaacgatgactcagaggctggagctaagcggccccggaccaccatcacagccaagcagctggagacattaaagaatgcatacaagaactcccccaagcctgcccggcacgtgagggagcagctgtcctcagagacaggcctggacatgagggtcgtacaggtttggtttcagaacagaagggccaaagagaaacgcctgaagaaggatgcagggcggcac

SEQ ID NO: 149267 - DNA, 2939 bp, Homo sapiens
  Payload ID: 9468
  Gene Symbol: LHX5
  Gene Name: LIM homeobox 5
  Uniprot ID: Q9H2C1
  ENST ID: ENST00000261731
  CDS Start-End: 575-1783
aaccaggtacaagctaatactcaacaatactgatgccttgttttttttgctctgtccggacagcaacgctgtagccaatttagatatgctataaatttaagaggttgccatggccacggtgcgcccattggccgctgggccccctacgtgcagcgccacgtcaccaaatctgaataaggatgcgcgaattacgcggcgaccagacaaagatgaggatccggaccgcttgaaagtgggggaaagtgccggcgcctccgccaccggggaaagccgctccgcagcgccgaggccagcagccacccgagatacctggggaagcccggaacaggcgccggggcgtgcggcccgtggcatgaggttgtgaacgccacccgccccccaccaccccactccgggcagcccagcgccaggccagagattgcccaaggactggaccggctgagtcttggtccggaccagactcgccctgcagctgctgagacaagaggcgaagggcagcggagggcccggcaggcccgagggccaggggcccaaagggagggcaaggcggccgaagccgccggggcgcggggctatgatggtgcactgcgccggttgcgagcggcccatcctcgaccgctttctgctgaacgtgctggaccgcgcgtggcacatcaaatgtgttcagtgctgcgagtgcaaaaccaacctctcggagaagtgcttctcgcgcgagggcaagctctactgcaaaaatgactttttcaggcgctttggcacgaaatgcgccggctgcgcgcaaggcatctcgcccagcgacctggtgcgcaaggcccggagcaaagtctttcacctcaactgtttcacctgcatggtgtgtaacaagcagctgtccaccggcgaggagctctacgtcatcgacgagaacaagttcgtgtgcaaagacgactacctgagctcatccagcctcaaggagggcagcctcaactcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgccccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgagggggggccgacccccatctccaccccgcgggctctccaggagcctcagcccaccgccagtactctcccagcaaccgcgagcaatttcttgggaccaaagtcaatactccggagggtcaagagatttcgagcacgctctagactttccccgggcccccacccacccacccagccaccgccacctctttggactgagagagggtgaggccaaggggcggagacggtgtttttccctctctctgcaatccgagtggcattttgtaatcttatttctcgctgtgctttccccgtctttaaaaaaaaagatgataagaaaaggagagagattgaaagagagggagaggaaagggggcaagatgaggaggagatggagagacagcgtcagccagagggagaagacggagagcgagcgaggaactcgcgtgaaccgggagccaccgagagggagaccgagccacctgcacgctggcgctccctggtggccaatcttgaggctcaaggtcagcttctctaggaatagggctgtgggtcaggaagtggccagccgggtccagctcccgctcttccttactttgacgtttatgttgagcccgagggagcaggccggactcgaacacgcacacatcctgctctccccctgggtggggcgccaggattgctgggctcagacccacagaccaccctccctgcccagggcctggaggctgggccgtcaggatgtacaatattatacttttttggaagttgaacgcttctagtttccttattttgtataaagaagaaacaaataaagtatgtttttgtgtttactgtttatttattgtactctagttatccggggttggacatttttatatttttaagaggaggtagggcagagtgacggaggggaagcagaaagaggtttacctaaaaaaaacaaaaaacaaaaacaaaaaaaatcaactttttttaaagagaaagattaataaaaaaaaatcttttttccctc

SEQ ID NO: 149268 - DNA, 3457 bp, Homo sapiens
  Payload ID: 9469
  Gene Symbol: LHX6
  Gene Name: LIM homeobox 6
  Uniprot ID: Q9UPM6
  ENST ID: ENST00000340587
  CDS Start-End: 202-1335
gaggcagcggcggcagcagccagggaggccggggctgcgcgcgggccgggggcgggggctgaggccgggcccggggcggcggggccggcgcctcggctctcctcctgctcctgcagcagcctctgctcccactgcggctgtggtccccctcggcgcagctctccgcgctgcgcgcccgctgagcccgaggttccccggcccatgtactggaagcatgagaacgccgccccggcgttgcccgagggctgccggctgccggccgagggcggccccgccaccgaccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaa

SEQ ID NO: 149269 - DNA, 3278 bp, Homo sapiens
  Payload ID: 9469
  Gene Symbol: LHX6
  Gene Name: LIM homeobox 6
  Uniprot ID: Q9UPM6
  ENST ID: ENST00000373754
  CDS Start-End: 110-1156
gttcggcgccggtttatataacaggcgcggggaggcgctgggctcaggctgtgcggagccagttcagcagccgccgccgcctgcgttccctccccccctcccccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaa

SEQ ID NO: 149270 - DNA, 3384 bp, Homo sapiens
  Payload ID: 9469
  Gene Symbol: LHX6
  Gene Name: LIM homeobox 6
  Uniprot ID: Q9UPM6
  ENST ID: ENST00000373755
  CDS Start-End: 110-1201
gttcggcgccggtttatataacaggcgcggggaggcgctgggctcaggctgtgcggagccagttcagcagccgccgccgcctgcgttccctccccccctcccccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaaca

SEQ ID NO: 149271 - DNA, 3465 bp, Homo sapiens
  Payload ID: 9469
  Gene Symbol: LHX6
  Gene Name: LIM homeobox 6
  Uniprot ID: Q9UPM6
  ENST ID: ENST00000394319
  CDS Start-End: 106-1284
ctctcctcctgctcctgcagcagcctctgctcccactgcggctgtggtccccctcggcgcagctctccgcgctgcgcgcccgctgagcccgaggttccccggcccatgtactggaagcatgagaacgccgccccggcgttgcccgagggctgccggctgccggccgagggcggccccgccaccgaccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaa

SEQ ID NO: 149272 - DNA, 2942 bp, Homo sapiens
  Payload ID: 9469
  Gene Symbol: LHX6
  Gene Name: LIM homeobox 6
  Uniprot ID: Q9UPM6
  ENST ID: ENST00000541397
  CDS Start-End: 72-1172
agtaaagacacaggcgaatcaagaggaggcgaggccggtattgtccgtctgaataggcgctgatagcgccgatgcgccgggggttgtgccggcgcagcgctgagaatcccgacgcggggccggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtgg

SEQ ID NO: 149273 - DNA, 666 bp, Homo sapiens
  Payload ID: 9469
  Gene Symbol: LHX6
  Gene Name: LIM homeobox 6
  ENST ID: ENST00000464484
  CDS Start-End: 290-397
gtagctgggctcggcgcggagggtggtgcgtgcacgtggccatccttctccaggaggcgacgaggcagtcccgcctggggtctcccggcggcgcgtccgactcttttcctcgaggctgaggctgccgaggctgtcgttccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaa

SEQ ID NO: 149274 - DNA, 736 bp, Homo sapiens
  Payload ID: 9469
  Gene Symbol: LHX6
  Gene Name: LIM homeobox 6
  ENST ID: ENST00000560485
  CDS Start-End: 636-736
tttagtaaagacacaggcgaatcaagaggaggcgaggccggtattgtccgtctgaataggcgctgatagcgccgatgcgccgggggttgtgccggcgcagcgctgagaatcccgacgcggggccggtacccggcgcgccgaggggctggagggtgctttttcctccccttgagcgcctctcttttctctttttggtcccgtttcgccccgatctcgctctctttttgctccgggtttccctccgactggccctcgaaaggcgcctgaatccgtgtcaatatagctgcttcaatttcgccgcgcgtgtcaggcgggcgggcgggcgggtgctcaccgcgctcggggttttcttttcttcaaccaccctccgcccctcacccatctcttttttattttctttctttctctcttttctcctttttgcattttgtgccgagaggagaagggagcgaggaaggggagtggggtgggggggcgggtggagagagaaaaaattcgatttttaattactaccattaaaaaatcaaatttgcaattctttgggcggcctgatggatctcactgattgacagttggaattgacactctggctacctcttatcttgggcattcacgacaatttctaattgcaggtgatggcccagccagggtccggctgcaaagcgaccacccgctgtcttgaagggaccgcgccgcccgccatggctcagtctgacgccgaggccctggcaggagc

SEQ ID NO: 149275 - DNA, 918 bp, Homo sapiens
  Payload ID: 9469
  Gene Symbol: LHX6
  Gene Name: LIM homeobox 6
  ENST ID: ENST00000482062
  CDS Start-End: 261-413
gtgcacgtggccatccttctccaggaggcgacgaggcagtcccgcctggggtctcccggcggcgcgtccgactcttttcctcgaggctgaggctgccgaggctgtcgttccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaa

SEQ ID NO: 149276 - DNA, 3587 bp, Homo sapiens
  Payload ID: 9469
  Gene Symbol: LHX6
  Gene Name: LIM homeobox 6
  Uniprot ID: Q9UPM6
  ENST ID: ENST00000559895
  CDS Start-End: 880-1410
gatgtgtggctccctgggtgatcttgcaacacttaggcaggagtgacctcagaggcctgtgaatggagcacctttgtcaatatcaggtcactgcggtccctggccctcctgccttctgacaatgggagtggggagtaaagggttaactgcttcccctcgtgtttatgggggtgggggttcagtgagtgccctggaggctaaagttcctcttcccagctaggcccaaacgacttcatgcaagcccctagccttctctggccctccgccttgagcccaagctctgtcgcgggctccagcgggagaagcctaccccctcccgcaaagcgagggtcccaggggaagcgcagagcgggaagcggccccccaccgcggcagagagcggcccagcggcggccagctgttgggggacagatgttgggggagccgagaggggagctgggggaggagcctcggggccgggacctccgagaagcggtcgttttaacctcttaattgctggttctgggttttttttccccctctggcttcttcccctacgggtttacctagaagggaaggagcagagagaataggtagggccccacctccaacccaccttgttcgcctcacaggatctaaagccttcaagaaggtcttgaacctaaaataagtgaacctccgtttgagtttcggcctctcggctcaatagcttgccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatcc

SEQ ID NO: 149277 - DNA, 2373 bp, Homo sapiens
  Payload ID: 9470
  Gene Symbol: LHX8
  Gene Name: LIM homeobox 8
  Uniprot ID: Q68G74
  ENST ID: ENST00000294638
  CDS Start-End: 665-1735
agaggcaagaggctagcggctggaccacttgtgctggagtggtaaagaactatcatgaatccatttactgaaagtgtccatttctgaactcaccctaaagaggacaaacaccgcaaagtagttaaaagtcaggcattcgcgtcggacgtctgggtttgaattctgccctggcttgactggaaacgcttcccctatttcttccgtagcggaccgggagagcttactggcgctctgcgaaccggctggaaagaaacaccgagtcactcgtacagactcttggtcgcagaacttggctttccgctattggtcctccagaaccgcttgaaacaactggccccagctggcgcatcagaccgcagtgaggaatgccgcggggcgggtggcgaaggcagggtctgcccgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcacccctctcttaccctcagaaactgtgggtagcaaggtataaaacggagtctgggaccggtaagtcccaaggtgagcccgtatacagctctgccatctctgaggggttatgcagattctgagcaggtgtcaggggctcatgtcagaggagtgcgggcggactacagccctggcggccgggaggactcgcaaaggcgccggggaagagggactggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtgaatgacctatgctggcatgtccggtgtctctcctgcagtgtttgcagaacctccctaggaaggcacaccagctgttatattaaagacaaagacattttctgcaaacttgattatttcagaaggtatggaactcgctgctctcgatgtgggagacacatccattctactgactgggtccggagagccaaggggaatgtctatcacttggcatgctttgcctgcttttcctgcaaaaggcaactttccacaggagaggagtttgctttggtggaagagaaagtcctctgcagagtacattatgactgcatgctggataatttaaaaagagaagtagaaaatgggaatgggattagtgtggaaggtgccctcctcacagagcaagatgttaaccatccaaaaccagcaaaaagagctcggaccagctttacagcagatcagcttcaggttatgcaagcacaatttgctcaggacaacaacccagatgcacagacactccagaaattggcagaaaggacaggcttgagcagacgtgtgatacaggtgtggtttcagaattgtagagcacgccacaagaaacacgtcagtcctaatcactcatcctccaccccagtcacagcagtcccaccctccaggctgtctccacccatgttagaagaaatggcttattctgcctacgtgccccaagatggaacgatgttaactgcgctgcatagttatatggatgctcattcaccaacaactcttggactccagcccttgttaccccattcaatgacacaactgccaataagtcatacctaattcttttttcagggatagacttgattaaggatataaatttgtcatttattatgtataaaataccattgaaaagatattactgttaattttttatttaacacctaaagcatttccaacatcactttgctgcccaggtatgtatctatagttggcctgcaagacacttttattaattcttcattttttgtaaaacttatgtttacaagaagaaaacaaatcaaaacattttttgtattgtctggaaatagttcactctagtgtgtatctgttaatttatttgtcatcaaaagagcactttgcctaaaagaaaggactgacaagtgtgcaaaatgtttacaatcttttgtgaaattgtagtttatcattagtttgtatctgtaagttattgtaataaatattacctgtattttttgttatatacaactttatactttgaagcttgtatctgtgaatttgcaactgaaatttattttgccaatgttttctgaatgaactgaataaagcttctgttgtagcatgccatgcaaacacattattgtgtttgtggttgatgaattatggctgtaaataacactatagtttaataagcccaccattctgagtttattaaacattttccattcttgtgaaaatttcaa

SEQ ID NO: 149278 - DNA, 1764 bp, Homo sapiens
  Payload ID: 9470
  Gene Symbol: LHX8
  Gene Name: LIM homeobox 8
  Uniprot ID: Q68G74
  ENST ID: ENST00000356261
  CDS Start-End: 86-1126
ctcacttaacctgagacatggagactgtaatttgggagatgaagcctcgagcctaaggcgctctcaggtccattgtcaggggctcatgtcagaggagtgcgggcggactacagccctggcggccgggaggactcgcaaaggcgccggggaagagggactggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtgaatgacctatgctggcatgtccggtgtctctcctgcagtgtttgcagaacctccctaggaaggcacaccagctgttatattaaagacaaagacattttctgcaaacttgattatttcagaaggtatggaactcgctgctctcgatgtgggagacacatccattctactgactgggtccggagagccaaggggaatgtctatcacttggcatgctttgcctgcttttcctgcaaaaggcaactttccacaggagaggagtttgctttggtggaagagaaagtcctctgcagagtacattatgactgcatgctggataatttaaaaagagaagtagaaaatgggaatgggattagtgtggaaggtgccctcctcacagagcaagatgttaaccatccaaaaccagcaaaaagagctcggaccagctttacagcagatcagcttcaggttatgcaagcacaatttgctcaggacaacaacccagatgcacagacactccagaaattggcagaaaggacaggcttgagcagacgtgtgatacaggtgtggtttcagaattgtagagcacgccacaagaaacacgtcagtcctaatcactcatcctccaccccagtcacagcagtcccaccctccaggctgtctccacccatgttagaagaaatggcttattctgcctacgtgccccaagatggaacgatgttaactgcgctgcatagttatatggatgctcattcaccaacaactcttggactccagcccttgttaccccattcaatgacacaactgccaataagtcatacctaattcttttttcagggatagacttgattaaggatataaatttgtcatttattatgtataaaataccattgaaaagatattactgttaattttttatttaacacctaaagcatttccaacatcactttgctgcccaggtatgtatctatagttggcctgcaagacacttttattaattcttcattttttgtaaaacttatgtttacaagaagaaaacaaatcaaaacattttttgtattgtctggaaatagttcactctagtgtgtatctgttaatttatttgtcatcaaaagagcactttgcctaaaagaaaggactgacaagtgtgcaaaatgtttacaatcttttgtgaaattgtagtttatcattagtttgtatctgtaagttattgtaataaatattacctgtattttttgttatatacaactttatactttgaagcttgtatctgtgaatttgcaactgaaatttattttgccaatgttttctgaatgaactgaataaagcttctgttgtagcatgccatgcaaacacattattgtgtttgtggttgatgaattatggctgtaaataacactatagtttaataagcccaccattctgagtttattaaacattttccattcttgtgaaaatttcaa

SEQ ID NO: 149279 - DNA, 7836 bp, Homo sapiens
  Payload ID: 9471
  Gene Symbol: LHX9
  Gene Name: LIM homeobox 9
  Uniprot ID: Q9NQ69
  ENST ID: ENST00000367387
  CDS Start-End: 426-1619
ggaacttgcaagcagccagggaacgctgaaaatagcacgtctttttctttctttgtgttcaaaactattttctttcttcaccagattttgttttcctccccccgctgcagttgtttcccattagtaactcgatctctcagagcagtaagattcgccttctacgcctctttttccctccgcccgaattgtttgttttctgcacatctccttcagggagccgctgaggcttccccccaactcttcccagttctttttgcttcccctcggccccccaagcagaccgatttccactccatctgtttcttctcctcctttctctccctctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcaggtttggttccaaaacgcacgagccaaattcagaaggaaccttttgcggcaggagaatgggggtgttgataaagctgacggcacgtcgcttccggccccgccctcagcagacagcggagctctcactccacccggcactgcgaccactttaacagacctgaccaatcccactatcactgtagtgacatccgtgacctctaacatggacagccacgaatccggaagcccctcacaaactaccttaacaaaccttttctaacattggttttttttttttagtttttaaattcttcctcttctttttattattattctaattattattattttattatttacaagactttttttttcttctaacccacaagatatttggggaataaaaataacagcttggtgtgtagcatctgcagccacttggcaaatgagtttacagtattgtctcctttaagtgaatatattttgtctacaaagtgtatttggatttaaaaaaattaattaggtctttcagttggtaaggagagtttttgaataattctaataagtgcctcttaaaattgtatgttacttatttccagaatctcgaagaaaaaagaaaaaagagtggtattattatgggcaaataatcatattcccacttaaatgattaggttaataaagaaccagataattaattagttactttttaaatcttgcaattgtatgtgtgattatggagttttgaaaacgttacattttttaaatcttaaaactgaaaacttgtttttagtatttctatttcttacctgaactgttaattcaagtgaggaatatgatgaaataaaagcattaactacagacattttaaatagtaatgattaattaggtgagaaatctattacaggaatgtgacttttccttctcttaggggtgtacaactctaaaaactttttacttggttatttgtttttcaacatttgaaaaatacttaagctccctatgtatccatgaaaattccgcattgattttgacattccatacttttaacctcctaaagctaaaaacaatagctcggaaaccattctttctagttactttttttcccagggaaaatggaaataagcaaaatataatgttttaagaagtaaaaaaatcaatataatttaattaatagctctattaattggcttcagctgtaccatgatattgtatctggcattctatatgaataatgtttaaaatacccagcctggtagacttataccaacaattggttttgttttgttttattttattttgacataggttgacttatgtattgaaaataatttttctgatattagagatttgaagttattagtcttaaagtagataaactcagaagccttgtggatgctgatctgaatatatttcctagtttacagtagcatttttttcttttaatttaagctaaaatcttaatggtctgggcagtggtgaatgttcatctattacgcttctgttgtagttaaataccaattagattgtggatttcctaaaaaaataaaaaagaagtcaagatatatgtcttgctttagtggattgttaagaataactttgcacatattttccactttttggaccccttaaatctcctttggtggtcgaagtggctatttaatagattttaaaggtgtccttctggctgtataaatgtgtggttacatattgacagttcactgcccacattaaagtgcattattgtaacttttgctcagggtctttagaaaattagcacagaaagtagcttattttttaaaaaaagatgatggaagataagttaacactgtaacagaagaaaggtgtgattgccattatatatttagcaagtatggttatcatcttatatggagcttaaatcttgacttttcatacttctattacattttgggcatttaccactaaccagaccaaacaaccttggtaaggctgagatcttattaatacacttttacaggtaaaatattgacacttataaattttgttctttgacagaacaatatatggtactatatagatctactttattaagtagactaattataactcagttctcctatgtgccttatgatataacttggaagtaagtttgtgaaaaatcaggatatatgtgttgtttgttaaattaactgttttaagcccttttaacacctcactagttttgtactgttttacctcttatttctgaaactctttttatggtgtatcctgttagaggggacaaacatgtcatagaaagcagttgtgcactctttcaaatatagttgataaattcaataatcttatatattgagcttcgtgtttatagtacagtaagtggtctagcaaaattgtccatgtttctttgtttattgataaatgcattgtatagaaactatttcccctaaatatttatggaccaaacaattgtgatatatcctattaaatttgtgtgaataaaacattttgaatctaaggagttttctttcccatcagttttatttaagttttaaccgtactagtgtgttccagcatctatatgtaaaagcttttcaaatggtaatacaacattgttagaaatatttaaacatacaaatagtttttagacttccaaacttctgattcatatgaaatgttacacattgttgcacaggcagtgtaattcaacctagaaatacctttgaatatatttgcttataacaaaagtaatgccccactgatttgactcagtccaatttttagaataaaaaggctaattagcatataaagtaattgcatggaacgaaaccttaaatatgattaagatttcatgttaggtctattgagcacaaatggatatttgtaaatctaaatagaaattgcagacccctaaaagccaagttgctctgtagttaataaattgtcactatgatttttttcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaaagagagagagagagacttaaatgtcatttactgaatgttaacgaaacttgtgttctttatggtgtctaacacaactgaaggcctaaaattatgtggtttaaacaaaattagataaaccatgtacaaaaccagagcaacctggcagtaatatgcccaccccatatttgaaaaaaattattattgaaaaaaatttcacacatttgtcaagcacagttgtaaaataaagtccaaaacattcatttcacctgcttgctaatgtgtattagtcctgttaatggcattttccaactgtaaattcaaagaaaagctatcacccatttaagagtatagggatcaaaccccagtaattttagcattattgtttatcacttcctttttaaacagaaatctctgcatgcacttttacatatgtcacctctagtgtacacctctgtatgatgacttatctttgctgtttcttgtatgataaatagctttcattaataaacatttatttgatgcaaacatagttaactttatgttaaacacatgctgttgaaattaattttgaacacttaaagaggcagcacagtacatttacaacttgttatactaatgaaaaaatacaaacagcatagtgagattaaattctggtaatctaggataaaattacttacttggtttttaccttttcatgacttattttcatttgttgtattcaattgccacatgtattaaaaataaaaaacaaagtgaacccaaattacaacaaaataaaccttagaataaactattgtgtaaaatttcagcaacttttttagattactagggtaaaatttatagatcctatgtgagtttacatgtttgctatgcaatgaacaaatttattgatgtatacaaatatattctgaactataaaaagatccaatctttgcatagttcaattacatatgattattacaaacaaaaaagcaaatggaaagacagacaaatatttaggaatgaggttttttttaattgttaaagggaatatttgaagaataaaattttagctattcctatttagccgtatatccaaagcatatgttaaacaaactaacatatactttccagaaaatttttcattatgatgaaatttttattatatacaaatgaaccctatgtaaatgatgtaacttttatgaatgacagacattaaatatttcacttacatgtattctcagaattttgaatgttttcttaaatgctttcacttcctgaataataaaaagaaaaaattttaaagaagagagagcaacttactaataaaaaaaagcaatgcaccatgacaagtagactattttgagtgatcacaaatcatgctggttttgtcagtaacttgaatgtttatgcctcattgaaacctcatccacagctatagcaacttaaatagattttccaatgcatttccagccagtttattcaaatctttgccctacagtcttgccttctttccctgttctgtcacctgtggcaatttcatttagaagtattttggaacttcgcctggttttacagacctttaaatatttgtctggtatgtgaaatgcaggaagagaccagagagggaaagaacataactgaaattagacatctgaaaaaaaaatacaaatttgaaacaggcacattttttaaaaccaaaaaaaaaaaaaaaaagagagagagagagaaaggagtactaattatgtgagtgggaagaggaagcgtgtgatgcagagctggaaggtctgttgtgctttactgtgatgtaaagcagtctttgagtctgggcaactgcacatttactgtttggtgtggaatagaaaaatgtggacctcttagttgagagcaggacactaaattttcatagcttctacctcccagttgcctgggttagtctaacttctggcagattgatcttgggcaaaaagcttcactgagagttagtgtctgtgtgctttggttgaatagccaccttaatactgacttacatagtgggtaggtttttgatacctcaaataaggataaaactccataataaaggacccaaagcaaatacttttaaaacttaggtgatttttcatcacctaaaacataaatagctttatttagcaaaatcccagtggaatctaccacacattcttttataataacccttttttgggagtcaaagtattgtttttttattagccacatataaatatcatctcattttctgttgcagtgtgactgcaaggcatgttgtggtggaaatcattagaactgggaagctctggaatggaaatttggaatcgtgtcattctaggctcttaaagagaatattagggataatactgttgtaaaaaataaatataaacacctaattttgtatgaagttttgctatttaaattttaactatgttataaacaaagctagctttacttgtagagagttcgtgtactcttgagctcattcaatagcttttacattttgtagtctcttccacaacagggcaaaataagcacagtaggacttagtccaaattgacgaaatatcattgaattttctttgaaagcatatatatagataaactctggattggtcttttagatctgttttctgtttttagtaattgggaacaaactcttgatattaaaataaataaaatgcctctaatgtaaagccacagccctgcttctagccaatgtcaaaaataggaagtttttttaatggtttactgttgattttaaacattttaataatagtgctctgccctcacaacagtttttttttcagaataatattatgatttaccttattttaaaaataaattataattctaacttaaaatattattttaaatgcccctctgggaagatttccgttttattttatgaggttccctggcagttgggggggtggtgaggttgggagagggaaagtttagaactgtgcatgatactcaaggaaaagtctatgaatatgatgtaagtagtaacattattgccacaactaaatttctgtttaactgtgttgcagaatatgataatgtcatctaacatcactccctacttgcaacattcctctgtgaatattaatatagttaaccctcccttattatgtatcatatcaataagtttctcttcccttggattaatttttgcttctttgcattacattttatcttgtgctaagataacaaaaagcaagcaagaataaagatccagatattagccatatgtagaaagttcctggtgtgcatttctgtgtacttttccctcacatattagaattgtcaggaaagtttttttcttttggaactttctgtttacattttgcatgatcttataaattaacctgaagagtaattggataccttttatggttatttgaaaataaaatttgctacaaataa

SEQ ID NO: 149280 - DNA, 758 bp, Homo sapiens
  Payload ID: 9471
  Gene Symbol: LHX9
  Gene Name: LIM homeobox 9
  ENST ID: ENST00000367388
  CDS Start-End: 191-355
acagctcaggcaggagcagtccccaacccaatctacaggcactgggaacttgcaagcagccagggaacgctgaaaatagcacgtctttttctttctttgtgttcaaaactattttctttcttcaccagattttgttttcctccccccgctgcagttgtttcccattagtaactcgatctctcagagcaccatgctctttcacgggatctccggaggccacatccaaggcatcatggaggagatggagcgcagatccaagactgaggcccgtctggccaaaggcgcccagctcaacggccgcgacgcggcgtctccccggcgaggatccgcagctccgagggcaagctgggcataagcaataggaggacggcgcgctgccgaggcgtccgagccaagcaggagcccaggtggccttagtctctgggcctgatgaccggacctgtggagtagattccgacgcgactgggtcatttccagttctctagacgctcggggcttgggacccctaaccgagagaatctcagggtttctggcatcccgactcagtccctctaaggagacagcactacgtttagcgccaggacccggcgggtgtcatgtgtagggggaaatcaaataaaacatacggaggagcgcggcacccagtcgaaacgcatgaactttataaccaacccttaaacaagctaatcaaccaccactgtttctactatccataataataaagtcatgtcctcttaataaagaaaactaattactta

SEQ ID NO: 149281 - DNA, 7413 bp, Homo sapiens
  Payload ID: 9471
  Gene Symbol: LHX9
  Gene Name: LIM homeobox 9
  Uniprot ID: Q9NQ69
  ENST ID: ENST00000367390
  CDS Start-End: 28-1194
gcgtgatccactccttttcctctaagaatgctgaacggtaccactctagaggcagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcaggtttggttccaaaacgcacgagccaaattcagaaggaaccttttgcggcaggagaatgggggtgttgataaagctgacggcacgtcgcttccggccccgccctcagcagacagcggagctctcactccacccggcactgcgaccactttaacagacctgaccaatcccactatcactgtagtgacatccgtgacctctaacatggacagccacgaatccggaagcccctcacaaactaccttaacaaaccttttctaacattggttttttttttttagtttttaaattcttcctcttctttttattattattctaattattattattttattatttacaagactttttttttcttctaacccacaagatatttggggaataaaaataacagcttggtgtgtagcatctgcagccacttggcaaatgagtttacagtattgtctcctttaagtgaatatattttgtctacaaagtgtatttggatttaaaaaaattaattaggtctttcagttggtaaggagagtttttgaataattctaataagtgcctcttaaaattgtatgttacttatttccagaatctcgaagaaaaaagaaaaaagagtggtattattatgggcaaataatcatattcccacttaaatgattaggttaataaagaaccagataattaattagttactttttaaatcttgcaattgtatgtgtgattatggagttttgaaaacgttacattttttaaatcttaaaactgaaaacttgtttttagtatttctatttcttacctgaactgttaattcaagtgaggaatatgatgaaataaaagcattaactacagacattttaaatagtaatgattaattaggtgagaaatctattacaggaatgtgacttttccttctcttaggggtgtacaactctaaaaactttttacttggttatttgtttttcaacatttgaaaaatacttaagctccctatgtatccatgaaaattccgcattgattttgacattccatacttttaacctcctaaagctaaaaacaatagctcggaaaccattctttctagttactttttttcccagggaaaatggaaataagcaaaatataatgttttaagaagtaaaaaaatcaatataatttaattaatagctctattaattggcttcagctgtaccatgatattgtatctggcattctatatgaataatgtttaaaatacccagcctggtagacttataccaacaattggttttgttttgttttattttattttgacataggttgacttatgtattgaaaataatttttctgatattagagatttgaagttattagtcttaaagtagataaactcagaagccttgtggatgctgatctgaatatatttcctagtttacagtagcatttttttcttttaatttaagctaaaatcttaatggtctgggcagtggtgaatgttcatctattacgcttctgttgtagttaaataccaattagattgtggatttcctaaaaaaataaaaaagaagtcaagatatatgtcttgctttagtggattgttaagaataactttgcacatattttccactttttggaccccttaaatctcctttggtggtcgaagtggctatttaatagattttaaaggtgtccttctggctgtataaatgtgtggttacatattgacagttcactgcccacattaaagtgcattattgtaacttttgctcagggtctttagaaaattagcacagaaagtagcttattttttaaaaaaagatgatggaagataagttaacactgtaacagaagaaaggtgtgattgccattatatatttagcaagtatggttatcatcttatatggagcttaaatcttgacttttcatacttctattacattttgggcatttaccactaaccagaccaaacaaccttggtaaggctgagatcttattaatacacttttacaggtaaaatattgacacttataaattttgttctttgacagaacaatatatggtactatatagatctactttattaagtagactaattataactcagttctcctatgtgccttatgatataacttggaagtaagtttgtgaaaaatcaggatatatgtgttgtttgttaaattaactgttttaagcccttttaacacctcactagttttgtactgttttacctcttatttctgaaactctttttatggtgtatcctgttagaggggacaaacatgtcatagaaagcagttgtgcactctttcaaatatagttgataaattcaataatcttatatattgagcttcgtgtttatagtacagtaagtggtctagcaaaattgtccatgtttctttgtttattgataaatgcattgtatagaaactatttcccctaaatatttatggaccaaacaattgtgatatatcctattaaatttgtgtgaataaaacattttgaatctaaggagttttctttcccatcagttttatttaagttttaaccgtactagtgtgttccagcatctatatgtaaaagcttttcaaatggtaatacaacattgttagaaatatttaaacatacaaatagtttttagacttccaaacttctgattcatatgaaatgttacacattgttgcacaggcagtgtaattcaacctagaaatacctttgaatatatttgcttataacaaaagtaatgccccactgatttgactcagtccaatttttagaataaaaaggctaattagcatataaagtaattgcatggaacgaaaccttaaatatgattaagatttcatgttaggtctattgagcacaaatggatatttgtaaatctaaatagaaattgcagacccctaaaagccaagttgctctgtagttaataaattgtcactatgatttttttcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaaagagagagagagagacttaaatgtcatttactgaatgttaacgaaacttgtgttctttatggtgtctaacacaactgaaggcctaaaattatgtggtttaaacaaaattagataaaccatgtacaaaaccagagcaacctggcagtaatatgcccaccccatatttgaaaaaaattattattgaaaaaaatttcacacatttgtcaagcacagttgtaaaataaagtccaaaacattcatttcacctgcttgctaatgtgtattagtcctgttaatggcattttccaactgtaaattcaaagaaaagctatcacccatttaagagtatagggatcaaaccccagtaattttagcattattgtttatcacttcctttttaaacagaaatctctgcatgcacttttacatatgtcacctctagtgtacacctctgtatgatgacttatctttgctgtttcttgtatgataaatagctttcattaataaacatttatttgatgcaaacatagttaactttatgttaaacacatgctgttgaaattaattttgaacacttaaagaggcagcacagtacatttacaacttgttatactaatgaaaaaatacaaacagcatagtgagattaaattctggtaatctaggataaaattacttacttggtttttaccttttcatgacttattttcatttgttgtattcaattgccacatgtattaaaaataaaaaacaaagtgaacccaaattacaacaaaataaaccttagaataaactattgtgtaaaatttcagcaacttttttagattactagggtaaaatttatagatcctatgtgagtttacatgtttgctatgcaatgaacaaatttattgatgtatacaaatatattctgaactataaaaagatccaatctttgcatagttcaattacatatgattattacaaacaaaaaagcaaatggaaagacagacaaatatttaggaatgaggttttttttaattgttaaagggaatatttgaagaataaaattttagctattcctatttagccgtatatccaaagcatatgttaaacaaactaacatatactttccagaaaatttttcattatgatgaaatttttattatatacaaatgaaccctatgtaaatgatgtaacttttatgaatgacagacattaaatatttcacttacatgtattctcagaattttgaatgttttcttaaatgctttcacttcctgaataataaaaagaaaaaattttaaagaagagagagcaacttactaataaaaaaaagcaatgcaccatgacaagtagactattttgagtgatcacaaatcatgctggttttgtcagtaacttgaatgtttatgcctcattgaaacctcatccacagctatagcaacttaaatagattttccaatgcatttccagccagtttattcaaatctttgccctacagtcttgccttctttccctgttctgtcacctgtggcaatttcatttagaagtattttggaacttcgcctggttttacagacctttaaatatttgtctggtatgtgaaatgcaggaagagaccagagagggaaagaacataactgaaattagacatctgaaaaaaaaatacaaatttgaaacaggcacattttttaaaaccaaaaaaaaaaaaaaaaagagagagagagagaaaggagtactaattatgtgagtgggaagaggaagcgtgtgatgcagagctggaaggtctgttgtgctttactgtgatgtaaagcagtctttgagtctgggcaactgcacatttactgtttggtgtggaatagaaaaatgtggacctcttagttgagagcaggacactaaattttcatagcttctacctcccagttgcctgggttagtctaacttctggcagattgatcttgggcaaaaagcttcactgagagttagtgtctgtgtgctttggttgaatagccaccttaatactgacttacatagtgggtaggtttttgatacctcaaataaggataaaactccataataaaggacccaaagcaaatacttttaaaacttaggtgatttttcatcacctaaaacataaatagctttatttagcaaaatcccagtggaatctaccacacattcttttataataacccttttttgggagtcaaagtattgtttttttattagccacatataaatatcatctcattttctgttgcagtgtgactgcaaggcatgttgtggtggaaatcattagaactgggaagctctggaatggaaatttggaatcgtgtcattctaggctcttaaagagaatattagggataatactgttgtaaaaaataaatataaacacctaattttgtatgaagttttgctatttaaattttaactatgttataaacaaagctagctttacttgtagagagttcgtgtactcttgagctcattcaatagcttttacattttgtagtctcttccacaacagggcaaaataagcacagtaggacttagtccaaattgacgaaatatcattgaattttctttgaaagcatatatatagataaactctggattggtcttttagatctgttttctgtttttagtaattgggaacaaactcttgatattaaaataaataaaatgcctctaatgtaaagccacagccctgcttctagccaatgtcaaaaataggaagtttttttaatggtttactgttgattttaaacattttaataatagtgctctgccctcacaacagtttttttttcagaataatattatgatttaccttattttaaaaataaattataattctaacttaaaatattattttaaatgcccctctgggaagatttccgttttattttatgaggttccctggcagttgggggggtggtgaggttgggagagggaaagtttagaactgtgcatgatactcaaggaaaagtctatgaatatgatgtaagtagtaacattattgccacaactaaatttctgtttaactgtgttgcagaatatgataatgtcatctaacatcactccctacttgcaacattcctctgtgaatattaatatagttaaccctcccttattatgtatcatatcaataagtttctcttcccttggattaatttttgcttctttgcattacattttatcttgtgctaagataacaaaaagcaagcaagaataaagatccagatattagccatatgtagaaagttcctggtgtgcatttctgtgtacttttccctcacatattagaattgtcaggaaagtttttttcttttggaactttctgtttacattttgcatgatcttataaattaacctgaagagtaattggataccttttatggttatttgaaaataaaatttgctacaaataaga

SEQ ID NO: 149282 - DNA, 1623 bp, Homo sapiens
  Payload ID: 9471
  Gene Symbol: LHX9
  Gene Name: LIM homeobox 9
  Uniprot ID: Q9NQ69
  ENST ID: ENST00000367391
  CDS Start-End: 42-1007
caaccaccattacggcgtgatccactccttttcctctaagaatgctgaacggtaccactctagaggcagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaaagagagagagagagacttaaatgtcatttactgaatgttaacgaaacttgtgttctttatggtgtctaacacaactgaaggcctaaaattatgtggtttaaacaaaattagataaaccatgtacaaaaccagagcaacctggcagtaatatgcccaccccatatttgaaaaaaattattattgaaaaaaatttcacacatttgtcaagcacagttgtaaaataaagtccaaaacattcatttcacctgcttgctaatgtgtattagtcctgttaatggcattttccaactgtaaattcaaagaaaagctatcacccatttaagagtatagggatcaaaccccagtaattttagcattattgtttatcacttcctttttaaacagaaatctctgcatgcacttttacatatgtcacctctagtgtacacctctgtatgatgacttatctttgctgtttcttgtatgataaatagctttcattaataaacatttatttgatgcaaacat

SEQ ID NO: 149283 - DNA, 2144 bp, Homo sapiens
  Payload ID: 9471
  Gene Symbol: LHX9
  Gene Name: LIM homeobox 9
  ENST ID: ENST00000561173
  CDS Start-End: 843-1853
tcatcctctcacttctttttttctttccttcttccctctctccctctctccctggcttttctcccgtcatctttctagctttggccacagttcccggtcgggctcccccgggcggagggaagcgggtctgcggccgggcggctcttgtgaggtatctaggatgtgccaggacacaggcaccgcagtcctgggaaaggcggcgggaagtagtggggaacgcaggctgacgaaggggacggaaggaacagagagcggccggcgcgtcctcctctctgggtaaagccgcgttggttcctgccgcagcgctgtgcttcggactcctagggggcctctggccgtttgaatgaatcgacaatatcagagtattgtggacactttttaatggggccggggaggggccgccgctgccgagaactgagggcgacagaacaatcccacctcttgtgaggagcaggtctgccattctgcttgtcagttctcaccttcccctcctccacggcaaagagtccctttcacacccttctgagtgtgcgggtgcgcccagttttacaagtcctctgtcctgccagggtagtgggagaagcacgcgatggggctagcgcccagtcctgcgggggcaggcgccaagctcccgggagtccgcaagtcgcttcctatattggcaagcttcaaatgagacattagaatctccggcaaccttccttcaaacctgaaccggggaagagaataagccgccctatggccaaggcgcaattgcgtacccgtgtgtacaggtccatgccctgtcccctacactctaattttctcaaagaaaattgttttgccaaaagtaaccctgagaaatgcagacgctccaaacgccctctccacttcggatgaagccagcatctagtagggtctccggccctcaagaagccatgctctttcacgggatctccggaggccacatccaaggcatcatggaggagatggagcgcagatccaagactgaggcccgtctggccaaaggcgcccagctcaacggccgcgacgcgggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacagaaggttctctgtgcagagatgtgcccgctgccaccttggcatttccgcctcggagatggtcatgcgcgcccgagactctgtctaccacctgagctgcttcacctgctccacttgcaacaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggttgtaatgagaatgaggcagaccacttggaccgggaccagcagccttatccaccctcgcagaagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaaagagagagagagagacttaaatgtcatttactgaatgttaacgaaacttgtgttctttatggtgtctaacacaactgaaggcctaaaattatgtggtttaaacaaaattagataaaccatgtacaaaaccagagcaacctggcagtaatatgcccaccccatatttgaaaaaaattattatt

SEQ ID NO: 149284 - DNA, 259 bp, Homo sapiens
  Payload ID: 9471
  Gene Symbol: LHX9
  Gene Name: LIM homeobox 9
  ENST ID: ENST00000475727
  CDS Start-End: 181-259
gtgcaaccaccattacggcgtgatccactccttttcctctaagaatgctgaacggtaccactctagaggcagtcctaacccagcgcagccgtttctgcgcctgatctcagcggacgcagtgcgggacttctccctttatttctgcagagctgagggcaggcggcgcaacaaatctcagccatgctctttcacgggatctccggaggccacatccaaggcatcatggaggagatggagcgcagatccaagactgaggccc

SEQ ID NO: 149285 - DNA, 431 bp, Homo sapiens
  Payload ID: 9471
  Gene Symbol: LHX9
  Gene Name: LIM homeobox 9
  ENST ID: ENST00000606127
  CDS Start-End: 321-431
ggaagggctgaacgcaacctcagagcgtttctctgggcaccggcccgcgtctgtgccctctgcccaccccttcctcctccccctcccgatttggaagcataaacagaaaataaaagacaggtggagagagctaagggtcagagggggaccctcagcgagacgcagggactggcccgcacctctggccgccgcctcccgccgagaaccgagttctagttggggaaacgtctgacatctggacatcaagtgcaaccaccattacggcgtgatccactccttttcctctaagaatgctgaacggtaccactctagaggcagccatgctctttcacgggatctccggaggccacatccaaggcatcatggaggagatggagcgcagatccaagactgaggcccgtctggccaaaggcgcccagctcaacggccgc

SEQ ID NO: 149286 - DNA, 3350 bp, Homo sapiens
  Payload ID: 9472
  Gene Symbol: LMX1A
  Gene Name: LIM homeobox transcription factor 1, alpha
  Uniprot ID: Q8TE12
  ENST ID: ENST00000294816
  CDS Start-End: 195-1343
ctcttttgcttctgcagacattcccggcactggccgactggcgggaggacctccccgcgcgccccgcacaccggctcctgcgcgcaccccaacagagcgcagcgccaggagtccagaagcgggcgggacgccctccgggtcccttacagtgccccttctcgacctggggcaggtcctcccggcccggcccgaacatgctggacggcctaaagatggaggagaacttccaaagcgcgatcgacacctcggcctccttctcctcgctgctgggcagagcggtgagccccaagtctgtctgcgagggctgtcagcgggtcatcttggacaggtttctgctgcggctcaacgacagcttctggcatgagcagtgcgtgcagtgcgcctcctgcaaagagcccctggagaccacctgcttctaccgggacaagaagctgtactgcaagtatgactacgagaagctgtttgctgttaaatgtgggggctgcttcgaggccatcgctcccaatgagtttgttatgcgggcccagaagagtgtataccacctgagctgcttctgctgctgtgtctgcgagcgacagcttcagaagggtgatgagtttgtcctgaaggaggggcagctgctctgcaaaggggactatgagaaggagcgggagctgctcagcctggtgagcccagcagcctcagactcaggtaaaagtgatgatgaagaaagtctctgcaagtcagcccatggggcagggaaaggaactgctgaggaaggcaaggaccataagcgccccaaacgtccgagaaccatcttgacaactcaacagaggcgagcattcaaggcctcatttgaagtatcctccaagccctgcaggaaggtgagagagactctggctgcagagacagggctgagtgtccgtgtcgtccaggtgtggttccaaaaccagagagcgaagatgaagaagctggccaggcgacagcagcagcagcagcaagatcagcagaacacccagaggctgagctctgctcagacaaacggtggtgggagtgctgggatggaaggaatcatgaacccctacacggctctgcccaccccacagcagctcctggccatcgagcagagtgtctacagctcagatcccttccgacagggtctcaccccaccccagatgcctggagaccacatgcacccttatggtgccgagccccttttccatgacctggatagcgacgacacctccctcagtaacctgggtgattgtttcctagcaacctcagaagctgggcctctgcagtccagagtgggaaaccccattgaccatctgtactccatgcagaattcttacttcacatcttgagtcttcccctagagttctgtgactaggctcccatatggaacaaccatattctttgaggggtcactggctttaggacagggaggccagggaagaggtgggttggggagggagttttgttggggatgctgttgtataatgatatggtgtagctcagcatttccaaagactgaatacattatggattgcatagtttaatgtttctaataagagtcttagcattagatatgaagacgtgtttatcattaaggacagagacttttaatatagacattctcatgcaaactagatacttagggactcctaacaacttcccaccatgtcggggaagctcttgtcaagaggtgcatatgtctatccatctacacaccaatagacagaaggacagatagatagatgtgtgtgtgtgagtgtgtaacctttcgtattttaccctcaaagtttattcctaattataacagacaccaactgtacagcaaaagtaactttattttcagtgtgaactatatttaaggaaatgcttgatgcacttaagttataaaatgagataatttacttttataaactttatttttagcttgacaagacttgtcagcagggcagagagggctgctccacctagccccatagctttgagtgctggggttcattctgttttcagagtgtctttcagatctggaaagaaattctgtgtggctgatggtgttctctcttgcattcttgctctctttggggttgaatcactgggcaggggtgggacagaataatctctgatcatgttctgagaaaatgtaaagcccagactcctgggctttcttttaaattctgacaagtggttgttgggcagtgctaggatgattggttcagctcttgagcttcagcatctgcaaatgtggatgaggctaatagtatgtacctacctcactgggaaacaccaaggcttaattcattcccaggacacatgagcagggctgagactaatatctgatatttgtttaagatacaaccaggccactcacttggcaaaggagggtacatagggttgcagagcaggagggctcctgaactccagagggcagttctgcctgctgaagtccctctgcaaagcctgtgctgaaggagacaccagctcagagcagttcagagggatcccagagtcccagagtggggaggaggtgaaggctgaggggatagaggagggcctggtggtgttctagagcagggttgggcaaactcctgcttgcgggcctgctttctatggcttgccagcaaagaatggtttttactttttttttgaggtcattaaaaaaaaggagaagaagaatatataacaggctgtctgtggcctggaaagcctgaaatatttgctatctgtattgtctggcccttacagaaaaagtttggggccccttgttttagagggtctgtttctaaagaacctcatggcgctcatagaggcagaaggttccagtggaaacccttggctcttccttccaactcactcctctgatcctcggcacagaagacccagcagccattgtacatggggacagttccacaccctggtctccagttgcggtgctaggatggtattgttctgtgctaggaagtctcctgggaacccagaatgagttggtggggaagacagcgggtcactgtggacccatccaggaggggccaggataggcttggcctcatttctggggacatcattggagacttgaacacagagacacgtccctatcactctggcaaggccagagggaacatgtccccttatggtagagtctatgttgtgtgatttttgtgctcttgtttataatttatgcaaaccaccaagaaacccaaaccagtctgatgagtgaaaattatgcagatgctgtatggccccacaggtttctgtggtaaagaccagttggagaatgtaggagatactatgtgagtgaaaatgaatagagatccttattccactccttaatggcataccaagatgaaattaaaatctcttac

SEQ ID NO: 149287 - DNA, 3545 bp, Homo sapiens
  Payload ID: 9472
  Gene Symbol: LMX1A
  Gene Name: LIM homeobox transcription factor 1, alpha
  Uniprot ID: Q8TE12
  ENST ID: ENST00000342310
  CDS Start-End: 384-1532
agaagctgcaggatccgccccggcgaagcagggccgactcgcacccaggaccctgggcctctgccttccctcctagccttggagaagcaactggccctctcctcccgctgaggagcgacgcgggctggtaggacgtcccgggaaggccggcagctcgcgaccacgtcccggcccagcctgggcgcgccgaggagcagagccagcggccggcgttcgctccggctccctccccggcgctccgaagccgagggcggctcctccggctgcagtctcgggggcgacgccttcccgggcagaagcttccagcagcgctccgcaacttctctctgctccagtcactgggagagagctcgcctaccaggtcctcccggcccggcccgaacatgctggacggcctaaagatggaggagaacttccaaagcgcgatcgacacctcggcctccttctcctcgctgctgggcagagcggtgagccccaagtctgtctgcgagggctgtcagcgggtcatcttggacaggtttctgctgcggctcaacgacagcttctggcatgagcagtgcgtgcagtgcgcctcctgcaaagagcccctggagaccacctgcttctaccgggacaagaagctgtactgcaagtatgactacgagaagctgtttgctgttaaatgtgggggctgcttcgaggccatcgctcccaatgagtttgttatgcgggcccagaagagtgtataccacctgagctgcttctgctgctgtgtctgcgagcgacagcttcagaagggtgatgagtttgtcctgaaggaggggcagctgctctgcaaaggggactatgagaaggagcgggagctgctcagcctggtgagcccagcagcctcagactcaggtaaaagtgatgatgaagaaagtctctgcaagtcagcccatggggcagggaaaggaactgctgaggaaggcaaggaccataagcgccccaaacgtccgagaaccatcttgacaactcaacagaggcgagcattcaaggcctcatttgaagtatcctccaagccctgcaggaaggtgagagagactctggctgcagagacagggctgagtgtccgtgtcgtccaggtgtggttccaaaaccagagagcgaagatgaagaagctggccaggcgacagcagcagcagcagcaagatcagcagaacacccagaggctgagctctgctcagacaaacggtggtgggagtgctgggatggaaggaatcatgaacccctacacggctctgcccaccccacagcagctcctggccatcgagcagagtgtctacagctcagatcccttccgacagggtctcaccccaccccagatgcctggagaccacatgcacccttatggtgccgagccccttttccatgacctggatagcgacgacacctccctcagtaacctgggtgattgtttcctagcaacctcagaagctgggcctctgcagtccagagtgggaaaccccattgaccatctgtactccatgcagaattcttacttcacatcttgagtcttcccctagagttctgtgactaggctcccatatggaacaaccatattctttgaggggtcactggctttaggacagggaggccagggaagaggtgggttggggagggagttttgttggggatgctgttgtataatgatatggtgtagctcagcatttccaaagactgaatacattatggattgcatagtttaatgtttctaataagagtcttagcattagatatgaagacgtgtttatcattaaggacagagacttttaatatagacattctcatgcaaactagatacttagggactcctaacaacttcccaccatgtcggggaagctcttgtcaagaggtgcatatgtctatccatctacacaccaatagacagaaggacagatagatagatgtgtgtgtgtgagtgtgtaacctttcgtattttaccctcaaagtttattcctaattataacagacaccaactgtacagcaaaagtaactttattttcagtgtgaactatatttaaggaaatgcttgatgcacttaagttataaaatgagataatttacttttataaactttatttttagcttgacaagacttgtcagcagggcagagagggctgctccacctagccccatagctttgagtgctggggttcattctgttttcagagtgtctttcagatctggaaagaaattctgtgtggctgatggtgttctctcttgcattcttgctctctttggggttgaatcactgggcaggggtgggacagaataatctctgatcatgttctgagaaaatgtaaagcccagactcctgggctttcttttaaattctgacaagtggttgttgggcagtgctaggatgattggttcagctcttgagcttcagcatctgcaaatgtggatgaggctaatagtatgtacctacctcactgggaaacaccaaggcttaattcattcccaggacacatgagcagggctgagactaatatctgatatttgtttaagatacaaccaggccactcacttggcaaaggagggtacatagggttgcagagcaggagggctcctgaactccagagggcagttctgcctgctgaagtccctctgcaaagcctgtgctgaaggagacaccagctcagagcagttcagagggatcccagagtcccagagtggggaggaggtgaaggctgaggggatagaggagggcctggtggtgttctagagcagggttgggcaaactcctgcttgcgggcctgctttctatggcttgccagcaaagaatggtttttactttttttttgaggtcattaaaaaaaaggagaagaagaatatataacaggctgtctgtggcctggaaagcctgaaatatttgctatctgtattgtctggcccttacagaaaaagtttggggccccttgttttagagggtctgtttctaaagaacctcatggcgctcatagaggcagaaggttccagtggaaacccttggctcttccttccaactcactcctctgatcctcggcacagaagacccagcagccattgtacatggggacagttccacaccctggtctccagttgcggtgctaggatggtattgttctgtgctaggaagtctcctgggaacccagaatgagttggtggggaagacagcgggtcactgtggacccatccaggaggggccaggataggcttggcctcatttctggggacatcattggagacttgaacacagagacacgtccctatcactctggcaaggccagagggaacatgtccccttatggtagagtctatgttgtgtgatttttgtgctcttgtttataatttatgcaaaccaccaagaaacccaaaccagtctgatgagtgaaaattatgcagatgctgtatggccccacaggtttctgtggtaaagaccagttggagaatgtaggagatactatgtgagtgaaaatgaatagagatccttattccactccttaatggcataccaagatgaaattaaaatctcttacaaatga

SEQ ID NO: 149288 - DNA, 1342 bp, Homo sapiens
  Payload ID: 9472
  Gene Symbol: LMX1A
  Gene Name: LIM homeobox transcription factor 1, alpha
  Uniprot ID: Q8TE12
  ENST ID: ENST00000367893
  CDS Start-End: 188-1336
ctgatctctcctcccaccctacattctcttggctggaccctatcctcctggctgattctggtcgccctggacactccctcagttctttcccaggagtgcggtggctgctggcgccgagtcccagcgggcacggacgtcagacgcatcgtttcttctcctctacaggtcctcccggcccggcccgaacatgctggacggcctaaagatggaggagaacttccaaagcgcgatcgacacctcggcctccttctcctcgctgctgggcagagcggtgagccccaagtctgtctgcgagggctgtcagcgggtcatcttggacaggtttctgctgcggctcaacgacagcttctggcatgagcagtgcgtgcagtgcgcctcctgcaaagagcccctggagaccacctgcttctaccgggacaagaagctgtactgcaagtatgactacgagaagctgtttgctgttaaatgtgggggctgcttcgaggccatcgctcccaatgagtttgttatgcgggcccagaagagtgtataccacctgagctgcttctgctgctgtgtctgcgagcgacagcttcagaagggtgatgagtttgtcctgaaggaggggcagctgctctgcaaaggggactatgagaaggagcgggagctgctcagcctggtgagcccagcagcctcagactcaggtaaaagtgatgatgaagaaagtctctgcaagtcagcccatggggcagggaaaggaactgctgaggaaggcaaggaccataagcgccccaaacgtccgagaaccatcttgacaactcaacagaggcgagcattcaaggcctcatttgaagtatcctccaagccctgcaggaaggtgagagagactctggctgcagagacagggctgagtgtccgtgtcgtccaggtgtggttccaaaaccagagagcgaagatgaagaagctggccaggcgacagcagcagcagcagcaagatcagcagaacacccagaggctgagctctgctcagacaaacggtggtgggagtgctgggatggaaggaatcatgaacccctacacggctctgcccaccccacagcagctcctggccatcgagcagagtgtctacagctcagatcccttccgacagggtctcaccccaccccagatgcctggagaccacatgcacccttatggtgccgagccccttttccatgacctggatagcgacgacacctccctcagtaacctgggtgattgtttcctagcaacctcagaagctgggcctctgcagtccagagtgggaaaccccattgaccatctgtactccatgcagaattcttacttcacatcttgagtcttc

SEQ ID NO: 149289 - DNA, 5809 bp, Homo sapiens
  Payload ID: 9473
  Gene Symbol: LMX1B
  Gene Name: LIM homeobox transcription factor 1, beta
  Uniprot ID: O60663
  ENST ID: ENST00000355497
  CDS Start-End: 8-1228
gcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccagggtgagccggggccggggcagggcctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggcaattgcagaagattgtgtcaggcgccctgctggaagtcaggtgcactagatccatccccagccccagtctgctcaactctatccctgtcagagcaaggaggctgggctgctggggcctgactggtgagcccaccctgtcccctggtgatcactgtgtccccttgttcaggtgctcacaaccctacctttaactctgaggtcaagccctaggccaccaccctaaagtctgcctggtccaacctttgagcaagtaaggataatgaatgtcccttttccacctttggggccctctgcctggatctctggaatcctctaagttcaacctgttctgtggttttgctcccgtttgctgggaaattcagtccccccagaatgtcctgggccaacctccttgcctgacatgtggcctcgtgtcacccattgggccccagcagccagctagcccttctgcagctcttcttacaaacagagcctctccaaggacctcagttgatgttctggtccttctgccgcctcagcccaccagggtccgtgccaccatgggtctcttgagcagcagctgcactggcttctggagagacacccctctttctccttttgcacatgcaccatctgaatcgtgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcctggaaagagctcagaaagggggttggtgcacgtggctgggcatcttaggaggcttcctgagggtgggtaaaggtgggaaggccctggcgctgcatcagatgagcagggcctggcagggacaagcctcttctcctttgggaagccctgcagcctcctagcaagaggctgattccccactctgcccccatctgaatgtccttttcatgttgcacgcagggaacctcaggaaggaggattgcctgatgcctgcctggctccatccttgagctctgggcaccacctagggtgagggagagcctgcagctctggggctaagtctgccctggggggaaagggctccacgctcacacgcacgcgctcgcacacacacactcacacctggacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtacactc

SEQ ID NO: 149290 - DNA, 5797 bp, Homo sapiens
  Payload ID: 9473
  Gene Symbol: LMX1B
  Gene Name: LIM homeobox transcription factor 1, beta
  Uniprot ID: O60663
  ENST ID: ENST00000373474
  CDS Start-End: 8-1216
gcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccaggtgaccacatgaacccctatgggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggcaattgcagaagattgtgtcaggcgccctgctggaagtcaggtgcactagatccatccccagccccagtctgctcaactctatccctgtcagagcaaggaggctgggctgctggggcctgactggtgagcccaccctgtcccctggtgatcactgtgtccccttgttcaggtgctcacaaccctacctttaactctgaggtcaagccctaggccaccaccctaaagtctgcctggtccaacctttgagcaagtaaggataatgaatgtcccttttccacctttggggccctctgcctggatctctggaatcctctaagttcaacctgttctgtggttttgctcccgtttgctgggaaattcagtccccccagaatgtcctgggccaacctccttgcctgacatgtggcctcgtgtcacccattgggccccagcagccagctagcccttctgcagctcttcttacaaacagagcctctccaaggacctcagttgatgttctggtccttctgccgcctcagcccaccagggtccgtgccaccatgggtctcttgagcagcagctgcactggcttctggagagacacccctctttctccttttgcacatgcaccatctgaatcgtgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcctggaaagagctcagaaagggggttggtgcacgtggctgggcatcttaggaggcttcctgagggtgggtaaaggtgggaaggccctggcgctgcatcagatgagcagggcctggcagggacaagcctcttctcctttgggaagccctgcagcctcctagcaagaggctgattccccactctgcccccatctgaatgtccttttcatgttgcacgcagggaacctcaggaaggaggattgcctgatgcctgcctggctccatccttgagctctgggcaccacctagggtgagggagagcctgcagctctggggctaagtctgccctggggggaaagggctccacgctcacacgcacgcgctcgcacacacacactcacacctggacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtacactc

SEQ ID NO: 149291 - DNA, 1195 bp, Homo sapiens
  Payload ID: 9473
  Gene Symbol: LMX1B
  Gene Name: LIM homeobox transcription factor 1, beta
  Uniprot ID: O60663
  ENST ID: ENST00000526117
  CDS Start-End: 8-1195
gcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctga

SEQ ID NO: 149292 - DNA, 1300 bp, Homo sapiens
  Payload ID: 9473
  Gene Symbol: LMX1B
  Gene Name: LIM homeobox transcription factor 1, beta
  ENST ID: ENST00000561065
  CDS Start-End: 51-1202
ccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccagggtgagccggggccggggcagggcctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagac

SEQ ID NO: 149293 - DNA, 4026 bp, Homo sapiens
  Payload ID: 9474
  Gene Symbol: LIX1
  Gene Name: limb and CNS expressed 1
  Uniprot ID: Q8N485
  ENST ID: ENST00000274382
  CDS Start-End: 297-1145
agcgagcttccccagctagcctgtaggtgggtgtgtttaacagaagaaagcaatgggaacccgcctgtcagccagcctttcgagctaattagctcagcatacaacaaagataagtgagcctgggaagagggccccctgaggggtctttagattctgggaaatgtctgattggcagatgttaaaagggattccttggtaatccagtgcatcaatgagctgcagaaattcagcccaggactgcaagaattcaggcatgaggacactctgtacaggaggctcacacaggcagacccaagatggacagaaccttggaatctctgagacacatcattgcccaagtcttgcctcacagagatccggctctagtcttcaaagacttgaacgttgtgtcaatgttacaggaattttgggaaagcaagcagcagcagaaggctgcattcccaagtgaaggtgtggtggtctatgagtcactgccagctcctgggcctccctttgtgagttacgtgaccctcccagggggaagctgttttggcaactttcagtgctgcttaagtagagccgaggccaggcgggatgcagctaaagtggccctgatcaactccctcttcaatgagctgccctctcgcaggatcaccaaggaattcattatggaaagtgttcaggaagcagtagcctccaccagcggcaccttagatgatgcagatgaccccagcaccagtgttggggcctatcactacatgctggagtcaaacatggggaagactatgctggagtttcaggagctgatgaccattttccaactattgcactggaatggaagcctaaaagcccttcgtgaaacaaagtgttcccgacaggaagtcatctcctactattctcagtattctctagatgaaaagatgcgcagccacatggccctggactggatcatgaaggagcgggactcaccaggaattgtctctcaagagctacgaatggccctgaggcagttggaggaagccaggaaagcaggacaagaactacggttttacaaagaaaagaaagaaatattgagcttagccctgactcagatctgcagtgaccctgacacttcctcacccagtgatgatcagctgagccttacggccctgtgtggctatcactagcaaggccaagccccgggtaccctcagtgatggcagaggccagattaacattaggaatctcagtgcagaggtcctcagaggctccagcatctctagtactacctgaaggctctcctaaccctctccacacattccatttacagagtatgagagtcgtaggacccttacaagacccaacaagccactcgatgcatttttctatcacattctcaatagttccagctcaggatgaaaggatagacacaaaattgtttgaaaaacattttccaggcctggctccaacctaaagcctgactgtcacgtgccttgcttgattttatatatattgtttcaagaatagtccaatatagcattccccaaatgaacagcagccagaattaggtgaagtagcatgatagcagtgtttaaaaatacttaggattaaataaataatatggattgttttaaaaaatatccaaggatcagagtctctttctaagctttgtaagctaagcaatagtttatgtcctactagatacactgcaaactacagtggggattttatctggacatcccaccatcaaagatcttgaaatagtaatagtatgaaaatactagataaaattaatgtttaaaatgtttttgtaacaataatttttaaaacccacactcttccatatatggggataaatatcacctagaaaagtagcctcactcttattcctcaagaattaatatccaatgtttatgagtcttgcaatcaattttgttcatttttaatttgcaaatcgataacctgaactaatttgttcttattttttgccactgcaaacatatatctacagagagaaaaattaatggcattttaaaggttaaaacattttgaaaaattattagcatgtaacaaagaatgcttgcatttgattagtttcaccagcatttgagagaaggaccctttagctctgtttgttgttcaagaacataagcaaccagtagctcaaatgtagtatcattattaagtttaagtcactggaatcttctttaaaggaaggataagacattgccatctctatttaactcatccatatgggtcaatcaactgattagaaaatcaaaaaacaataaaaactttttttttttttttttttttagtagagacgggatttcatcatgttgcccaggctggtcttgaactcctgggctcaagccatctgcctgcctccacctcccaaaatgctgagattacaggtgtgagccaccatgcctggcctaaactaatttttagatagttcctggtcactcaaatttaagaatgtcagcaatgtcaattttaaatgctcataggtctttccatatctgtaacatgaaaatgattattctgcattttattcagtagtccaaattaaagaaaatgtttttctcaatttaaaataatttctttttcttttgtttatgcaagtgcatacatgcttcactgaaagcaaaaccattataattacattaaagtttataaaatatgatattttaacctcatatctaataagtatgtacaaaggtaaccatcactccttaaatccacatgaaaactactgtaactgatcatgtattttggaattagacttgataataaaagattatcatgtatcacatatctcacaccaggggaacaattagctacataattgtcataccttaatatcttttaaaggtaacagtaattttcaacacattttattttaaaatattattttaacaaaagttacattcctctccacaatgaggctaaatgtcacccacgaaagaactttattcccttatattcctgaaaagaaatcagaattaacatttttatgttgaataaattttaaaatttaggaaatgttctatttaaagttaatttctttcataaagccattactctttacattgtcatttccaaaaagccacaatttcccatgctggatgtgatgaaagttaggcacacctttactgcattagcagcctttgacaatgacttcctcaaactgacaccatcttaattagatgcagggacagggatcagatgggacaatatcaaatttactttgtgccctacaagttaaaaactgcacccattctgtaaattgaatatagaggttctcccttggccactgtcagcttttcttgactggccaaaactgcccattcttcctggaatggtatgaaagcttcagcaaaataaataaaagtcagaatctttgctggtccctttaatgctgatttgatagtaaatcaatttcagctgagacataagggctgtcagtctatcatataaacatctttaactatagcctagagaaaagagggttgaagagcaaagcagattttttttttccttttctatatcttgttctgaacaacacactgtgataaaggggactagagtggaagattccctatttaaacacatgaagctctgggtcctagccttttttggttataagccctttgagaatctgataaaagctgtggatcatctcctaggaaaatagaacaaaacatacatattcacattacacagttccagagtatgtggaccccccaaagtccagagattgccctaggggatctttagattcttgtttagaactgttgattttgaacacaacatacactgtcaaactttacatcagggatccaacataactcagacatagcccaggtagcctgtttctaacacaactgtcataatcctgaaatccaaaattgcactgtgtttgacatgagatagtttaagttccacaaaatccaaatttaccatattattgtttttaaaaaagcagtttagagcaaactgtcactaaacttggataaatgggtcagaaagtacagatttaataaagtcgtacctctaatgttcagaa

SEQ ID NO: 149294 - DNA, 529 bp, Homo sapiens
  Payload ID: 9474
  Gene Symbol: LIX1
  Gene Name: limb and CNS expressed 1
  ENST ID: ENST00000512378
  CDS Start-End: 339-529
ctgggaagagggccccctgaggggtctttagattctgggaaatgtctgattggcagatgttaaaagggattccttggtaatccagtgcatcaatgagctgcagaaattcagcccaggactgcaagaattcaggcatgaggacactctgtacaggaggctcacacaggcagacccaagatggacagaaccttggaatctctgagacacatcattgcccaagtcttgcctcacagagatccggctctagtcttcaaagactttaagatttgttagtctgaactcaattttaacaacttctgaaactcatgtgttaagttacagcccataataggatacagatgcataaggtgaacgttgtgtcaatgttacaggaattttgggaaagcaagcagcagcagaaggctgcattcccaagtgaaggtgtggtggtctatgagtcactgccagctcctgggcctccctttgtgagttacgtgaccctcccagggggaagctgttttggcaactttcagtgctgcttaagtagagc

SEQ ID NO: 149295 - DNA, 3975 bp, Homo sapiens
  Payload ID: 9475
  Gene Symbol: LIX1L
  Gene Name: limb and CNS expressed 1 like
  Uniprot ID: Q8IVB5
  ENST ID: ENST00000604000
  CDS Start-End: 75-1088
gctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggccgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatggcaacagggaggaagctgacaacccaaatacagggattggtgccttccgattcatgctggaatccaacaagggcaaatcaatgttggagttccaggagctaatgacagtttttcaactgctacactggaatggcagccttaaggccatgagggaacgacaatgctctcggcaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttccctaccttattattctgaaggaagtagagatcttgcttctgaaacccctcctaagaaactgcccagggacaagataaattacaaacaattcatgggagtttactacctaagttgcttctagggcatatgtataccatactagtagtctagatttctggatatactctacagtagatgggggttatggttgaaactgattctctttcagtattccctctaaacatctcccctactcccccagcttagttaaaccctgcgtttggaccttcctgcctgcagctattagtagaaagtaaaacatatttccatatttcccttcacctaacattttattttttggaagcgttatcagtcctatttggttagtgagaaccatgttccccttattcccgctaagttgctgctgtttactaccttagattctcatttgttttctctttctttcctctccttccacattaattattagaacataagttgatcaggaaaattaaatgagactttagtattttggcacttcctaattgacaccttgggagactgcaggaagggaaagagaatcaatgatcagttatttgtgtgtgtgtgtggtttttttttttttttggaagacagagtctcacacttttgcccaggctggagtgcagtggcgtgatctcggctcactgcaacctctgcctccagggttcaagcgattctcttgcctcagcttcccgagtagctgggattacaggcacacgccacaacgcctggctaatttttatatttttagtagagacagggtttcaccatgttggccaggctgttcttgaactcctgacataaggtaatccacccgcctcagcctcccaaagtgctgggattacaggcgtgaggcactgagcctggcctatttgtggtttttttttggttttgtttttgtttttgtttttgagacggagtcttgctctgtcgcccaggctagagtgcagtggcgcgatctcggctcactgcaacctccgcctcccagattcacaccattctcctgcctcagcctcccgagtagctgggattacaggtgcccaccaccacgcccagctaattttttgtatttttagtagagacggggtttcaccatgttagccaggacggtctccatctcctgacctcgtgatccacctgcctcggcctcccaaactatttgtgtgttttttttttttttgagacggagtctcgctctgtcgcccaggctggagtgcagtggcgctatctcggctcactgcaagctccgcctcccgggttcacgccactctcctgcctcagcctccttagtagctgggactacaggcgcccgccaccatgcctggctaatttttttgtatttttagtagagacggggtttcaccgtgtttgacaggatggtctcgatttcctgacttcgtgatccgcccgcctcggcctcccaaagtgctgggattacaggcgtgagccaccgcgcccggcactatttgtgtttttaacaccattctcccccacttctctcctgggtgacataagagagaaataacctgtagtacagcagctaaagtattctcctttcagagaatttttttggaggtctctaatatatatttcccccttgtctctgtgatctcttatttatactatattattgtcccatgtactttctaaactgagcttggaacatttagtattcctgcaattggacttcccacttaacaattatacagactttgcttttagaaatagattaggttccaaacagaaagttcaagtgtaacaacaacaataaaaatagattatgaaacaggctataattggctcttttggatttgataggggcaagatgaaaggcaactttcttgcttttgaaatcatgttgggtaagaggtaaggaatccagctacaattttattagtgcttgaaacgggcttccttgaattctccaggccctatcattttttttttcttactaatcagaagagagctggggtagaagccccatgtttgtattccatgaaacacgtcgggttggagtaaaggcaaaaacagctagacacaccaggtgtgtctgtttgacatttataagctggcactcatcaacactcctgtttctcctttctctgggacgtgtggattaaggggtgtgagttgtgggaagaattgccctcgtacctcctggatttattatttttctcaaataccaaccagtaagatcccaaataacttgagaaaaattgtttcctgatctgtccacttctggtgtcaaagattttactcatcttcttagtacattctatgtattttatatgtataattttatacaattaaaaatagatttttgtctagtga

SEQ ID NO: 149296 - DNA, 2933 bp, Homo sapiens
  Payload ID: 9476
  Gene Symbol: LBH
  Gene Name: limb bud and heart development
  Uniprot ID: Q53QV2
  ENST ID: ENST00000395323
  CDS Start-End: 209-526
ggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgcctttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcca

SEQ ID NO: 149297 - DNA, 543 bp, Homo sapiens
  Payload ID: 9476
  Gene Symbol: LBH
  Gene Name: limb bud and heart development
  ENST ID: ENST00000404397
  CDS Start-End: 203-349
gagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccaggattgtgaagaaccctagagaatactcgggtatgggatacgccagaagagctagcccttcccagctcacatcttggaaaacagcgtgtgaaccaattagcacctctcagccatgaagaaaacgttgagtcacagccttgtacatgaggttctcagagtgagatgggaccacatagggccaacctgcccagcccctgcctgcaggcggagaag

SEQ ID NO: 149298 - DNA, 559 bp, Homo sapiens
  Payload ID: 9476
  Gene Symbol: LBH
  Gene Name: limb bud and heart development
  ENST ID: ENST00000406087
  CDS Start-End: 203-361
gagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccaggtgaatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccag

SEQ ID NO: 149299 - DNA, 485 bp, Homo sapiens
  Payload ID: 9476
  Gene Symbol: LBH
  Gene Name: limb bud and heart development
  ENST ID: ENST00000401506
  CDS Start-End: 11-346
ttttgtttgcatgcaagtctcaacgtcgaggccggcagcagcggggctgagctgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatc

SEQ ID NO: 149300 - DNA, 756 bp, Homo sapiens
  Payload ID: 9476
  Gene Symbol: LBH
  Gene Name: limb bud and heart development
  ENST ID: ENST00000407930
  CDS Start-End: 441-707
gaggccggcagcagcggggctgagctggtgcggccgcagggtttgcagagctccgggggggtggggggcgggaaacgctctccccacacgtaaccccactaaagccacaagcagcagggcacgcgctgcagcctctcaacccctgccctctccaccgcccctaaaaaccgacgcacattggtgggggccgggactgggaggagccgccttcgccgtgctgaaggggaaggagcccgggccgggcgcggggcgtcggaggtttgccccggactggggatcggagccgggagggatgcagagagaggcaggcccctgactgctgggacttccttgctggcagtttcttccttcctgctctgggttagaggagaagcggccgggggcgagcgccggcagccccggagcgcgctctcagccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaa

SEQ ID NO: 149301 - DNA, 550 bp, Homo sapiens
  Payload ID: 9476
  Gene Symbol: LBH
  Gene Name: limb bud and heart development
  ENST ID: ENST00000412933
  CDS Start-End: 204-335
tgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagtagtttaccatatgagaggtttcaccatgttagccaggatggtctcgatctcctgacctcgtgatccacctgcctcagcatccgaaagcactgggattacagatcttcccagacccgtcagattttgaccgctgctgcaaactgaaggaccgtctgccctccatagtggtggaacccacagaaggggaggtggagagcggggagctccggtggccccc

SEQ ID NO: 149302 - DNA, 7997 bp, Homo sapiens
  Payload ID: 9477
  Gene Symbol: LMBR1
  Gene Name: limb development membrane protein 1
  Uniprot ID: Q8WVP7
  ENST ID: ENST00000353442
  CDS Start-End: 238-1710
gccccgcccccgccccgcccccgactgcgcggcgcccgccctcccttagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttcatatttggtttataagcatttatatgtggggtttatttgttcttttgttttttccatcttaaatattatcatggctaaaacttaagggtatttatagtttaattccatttcagttttatagagggcagtaattattctgatgaatgttgaattaagaaatggatattttctttctctgttgtgcagttattggtagatcaatttcttataacccacaatgtagcatcaataattgatagcatgtattttatttaattacttgaattatttagacttgatttctctaattttttccataaaaggactgaacagcacctacttgtggtctggacagcttaacccagagttcctggaagaataaatgctgttagcatctggttaatttactggcagacagaagcctacttacagtggctttcaactttttgaccacagtaagaaataacccattacacacacacacacacacacactctctctctctctctctctctctctctgtctctcagatacgtataagcaaaaatttaacaagacagtacttgtttttcctaagtgtgcatgctggcatcttctgttttattatttttaaaaatactagacacagacactaagttactttgtggcctcctaatagatggcagacttcagtttgaaaagcatccctttggaatgtggtttaaaagaagaaataatacaaagacctttttggagttttttttttttttggtttttgaatattgtttaggtaaaaattattgctgcaaacacaactgaagcaaaagtactgtgtacgcaaattacttgttgcactgtagaaaatgtaatatcaggagaagttcctaaaactcacaaatatatacaaaatttcaaaacttggtgattgatccatatgtcttgaaggaatattaggcaataaacttaccttttcaagagaagttatttaacttccaattctgtgttctttaattaggaaaaaattttttcaaggttaactataatcaaataggaacttcacacaaaacctcattattcttggatatggatttggtgttctgctgttacttctaaaggtggtacagaagtcaagtttatgagcctggattatgaacagcagggcggccctgatgtgagtggttgtggaggactagagtgatgtagaagaatctgttgtgtctgagtgtgaggaggtggagagtcacgtgtgggctatgggtctgagaactgaagttttaacagttactaaaactgttttgtggctgttgtaatgtcttctcctttcctttcctttgaaaagctgttactgaatgaacgatgccgcttacaaacactgacacttcagaaccaagcatatttgatactgctgtagctatttatattgattctgcaacttctctttaacagcatcttgaagtcatccacagttgttctatatggactccacagtagagtcagagaactaagtgacaagtggagcatcgtcctcctcctgctcacttcctcctcgccacctctctggcctggctatccttcagtctgaagagtgattcactttttcttttctttttagtctttactgtggaatctcatcaaagacttggaagcaggggtggtgagaggggcctggggcgtggtgtggagggtcgagttctttgtcgtcccacagtcacccccaggaccaccttgcgaagccgaaaatacacatctgcattttaccgacaaggaacgccactgagaaagctgcagacatttgcctggggtcacgcttacagtgggcagatgaactggatgtaaatacaggccagtacaaccgcagtctcattttttctttgttttaggttttcagtttcttgttcattcatgtaccttacagttctattatctggttgataaagattcatgacaggtatcctcattctagattataacctttattcttatcaaatgcctccagtcccacaattcgctaagaattctctttctggacttgatagtgatttaatgattccccccgcccatggaatggtaggctcctaattaagtggatttaaaggcaaaaagggatgtgtgagaaggcacaagaagtggcttcatcttgcaaggtgactgtcagacaagtgggttccaacctgttaaaataagggaggaatggccacatcccgtagggactgctgtagctgaccaggaagacacaatgagggcagcagacagggctctccctgtccgctgagtcctcccatgaactcatgtttccaaaggccccactctttcttggtcagtgtcccagtttttatagaagagacctgatgaggctgtggagtaattgtataaaagcttgcactgttttcctgacttgacctgacaatgtggcgttatcttcaaattgtccagagaagtagctacttcattcaggtcctttttagcgttctgtggttgcaacttggtctcgcaagctttcgatgggcgcgccattccatggccacttttcagtaagaaaattgcctgattttctgttaactgtcacaggctgccctggaccattcctcagaactcatgggattttcgcgaccctcatcctcagtgaagttagatgaccattcctgcctttcatcccaccgattttcctaagtatctgttgcctgcaactaacactagttcctgtgtcagtaaagtactgcacttggttgcaaagaatagagatggactctgccaacataggcacggaaggtttacggggtggatggcatggctcacagatgtgatgagaaagccccggaagaagtgttgggcacagccttaggcacaacctttcctgggctcttcccatcactgaatgatccatgtatctccgggactctccttctagatccaaagtttagggcggcggaatcggactgctctggcctttgacacgtgcctgtgctttgcctgtcaacgctatggggagagagatgtcagcttacagaaaattgaggttctgtgattcagtttccctctgctctcttagaataaaagtgcttactcattgtttaaagcattctccaaattagtctgcaaattttttgatagtatacatccttaaaaaa

SEQ ID NO: 149303 - DNA, 4727 bp, Homo sapiens
  Payload ID: 9477
  Gene Symbol: LMBR1
  Gene Name: limb development membrane protein 1
  ENST ID: ENST00000359422
  CDS Start-End: 672-1526
gactgcgcggcgcccgccctcccttagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactggggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagtttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgatttc

SEQ ID NO: 149304 - DNA, 451 bp, Homo sapiens
  Payload ID: 9477
  Gene Symbol: LMBR1
  Gene Name: limb development membrane protein 1
  ENST ID: ENST00000414218
  CDS Start-End: 187-303
agagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttc

SEQ ID NO: 149305 - DNA, 762 bp, Homo sapiens
  Payload ID: 9477
  Gene Symbol: LMBR1
  Gene Name: limb development membrane protein 1
  ENST ID: ENST00000444719
  CDS Start-End: 165-356
tgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgtatgtattttaaagttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattc

SEQ ID NO: 149306 - DNA, 930 bp, Homo sapiens
  Payload ID: 9477
  Gene Symbol: LMBR1
  Gene Name: limb development membrane protein 1
  ENST ID: ENST00000434503
  CDS Start-End: 216-449
gactgcgcggcgcccgccctcccttagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctat

SEQ ID NO: 149307 - DNA, 2229 bp, Homo sapiens
  Payload ID: 9477
  Gene Symbol: LMBR1
  Gene Name: limb development membrane protein 1
  ENST ID: ENST00000434453
  CDS Start-End: 224-370
ccgcccccgactgcgcggcgcccgccctcccttagtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcaggcaaatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatgtagagactggtttcaccgtgttagccaggatggtctcgatctcctgaccttgtgatccgcccgcctcagcctcccaaagtgctgggattacaggcgtgagccaccgtgcccggctgcatgtgtgtattatatatagcatatgcagtttatacctttaaaacctttaatattatattgtgttttccataccttttatgttcttcaaaaccatttttagtggtgtaacctgagccatgtatttagcaatatattaagctagtggttttcaaaggctatttcgtcattttaaagggtggaaccatttatccctccagtgacttgctacctgcatttttttcagatttgcaatagaaaacagctgagttgttcctcaggcaccaaacccaccctgtcctctttgtgaaacatttcacttcaccagtaaactgttgttgagcatctagaggatttttaaattttcattattatttgggtttctgacaatttctttacatggaaattagaatgaaaattattaggctaatgagtattaattgctaaactgttttctagaattacttgtttatattctcttgatagaccatgaaggtgcctcttgtttttagccataaacttaataacagtgaatattagtatctttaaaatcttttccattttcatgggtagaaggtagtttctcattattgtaatgttaatttaaaaaatttttagtcagataggacattttaattttaatttataaaatatagaaaaatatctaatacatatatcattttatttttatttatttattttattattataatttttttgagatgaagtgttgctctgttgcccaggctggagtgcagtggcgcagtcttggctcactgcaacctctacctcccgggttcaagcgattctcctgcctcagcttcctgaggagcggggactacaggtgtgtgccaccacgcccagatcatttttatatttttagtagagacagggggtttcaccatgttggccaggctggcctcaaactcctgacctcaagtgatccaccctcttcggcctctgaaatgctgggattacaggcatgagccaccgtgcccagcccatgtatattttatttgattaatgtcctttgcccttttttgtggttgttgcttttttcatattgaatttatgatctctttgtttgaacacatcagcttttcatttcaattttttacatgtttttctgattgttattttgctttttaatattaattgcttttttccagaatttgaatattttttataatatttggtttttctttttctcttggtgtctctaattgtttttgtgtttagaagattgtttcccaccctgagatatgacagctagttgtcccaataccattaattgaatattcttttctgtactgattttttatgcttcattttcagtaagctaaatattatattagcgtttgtttctgggctcaggtatgcaggttttggagtcagatagacctgggcttgaatttcaaatctgtctgaaacccttagcaaccttgagcatattgtttacgctttcagagtctcagtcttttatctataaaatgaccatatcaaggtctagtttatagaattattatatgtagtaagtggaatatatgtatagtataaagtacctagtctattgcctggtggccaagagta

SEQ ID NO: 149308 - DNA, 3629 bp, Homo sapiens
  Payload ID: 9477
  Gene Symbol: LMBR1
  Gene Name: limb development membrane protein 1
  ENST ID: ENST00000448926
  CDS Start-End: 1-138
ggtttgtggaatcttgcttcccttttttccaacctttgtttatttgtattgatgccctttgcctttttctttctggaatcagaaggctttgctggcctgaaaaaggagggcaagatgtccaggcaaaaccttgtttaaatgttcatcaccatagaaacatgacagcttctccatagagcttttggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactggggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattata

SEQ ID NO: 149309 - DNA, 3457 bp, Homo sapiens
  Payload ID: 9477
  Gene Symbol: LMBR1
  Gene Name: limb development membrane protein 1
  ENST ID: ENST00000415428
  CDS Start-End: 1-1590
gggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgtgggaatgctttgtgcgggaaatccagaagttgcaacaggaagacaagtgccagaagaacaagctggacagctacttttgggaaaatggattcaggagggaggagacatgatagcaaacccacggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttca

SEQ ID NO: 149310 - DNA, 678 bp, Homo sapiens
  Payload ID: 9477
  Gene Symbol: LMBR1
  Gene Name: limb development membrane protein 1
  ENST ID: ENST00000434278
  CDS Start-End: 190-333
gtcagagctgctcgtctgaggctgctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacggttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatggg

SEQ ID NO: 149311 - DNA, 2922 bp, Homo sapiens
  Payload ID: 9477
  Gene Symbol: LMBR1
  Gene Name: limb development membrane protein 1
  ENST ID: ENST00000454132
  CDS Start-End: 167-325
gctgaggcgacggccggtgtcgtggtcgcggtacctgttccaacacggctcgcgggcccgtgccggctccggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcaggatctccttctgtcccctaggccggagagcagtggggcaatcatggctgactgtagcctcgacctcctgggctcaagtgattctccaacctcagcctcctgagtatcctgcactacagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaaggagggcaagatgtccaggcaaaaccttgtttaaatgttcatcaccatagaaacatgacagcttctccatagagcttttggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataatta

SEQ ID NO: 149312 - DNA, 2934 bp, Homo sapiens
  Payload ID: 9478
  Gene Symbol: LMBR1L
  Gene Name: limb development membrane protein 1-like
  Uniprot ID: Q6UX01
  ENST ID: ENST00000267102
  CDS Start-End: 344-1813
tgtgtcgtcactagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagcacctgtctctgtgtatatttgaacagccttgctcccaccagcccggcgtctgcccagtaagagaagcagaggggtcctgcccaccatccttttccttccccttcatctatattattaccatcctttggggacttggatctggtgttaggccatgcagttgggcagtgggaaactcctccatcctcagtcttgcttaaagctggcttgtcccctgactcctccttatattcatggccttgtttctgtaccttgagtattgggggtaggacatgggcataggagtaggctaacctccccgatacactcataccttcagccctatcctccctggcttaactattggatatagagtaaaataagtggctggctgacaaggattttcatttcctacctgagagaagaatctagctttttactagaggccatcagtttcttgaaaagcccatgtgctatgttgggagtaagagcgcaaaacttaggcttatacagattgtgtattgcacagcttccagggacaccattcacctcatagtcattgtgtggatagttactatgatagttttctaataaatgtcagtcatcttga

SEQ ID NO: 149313 - DNA, 2334 bp, Homo sapiens
  Payload ID: 9478
  Gene Symbol: LMBR1L
  Gene Name: limb development membrane protein 1-like
  ENST ID: ENST00000417750
  CDS Start-End: 127-351
gtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctgtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagca

SEQ ID NO: 149314 - DNA, 1081 bp, Homo sapiens
  Payload ID: 9478
  Gene Symbol: LMBR1L
  Gene Name: limb development membrane protein 1-like
  ENST ID: ENST00000457164
  CDS Start-End: 296-757
ctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacaggctcgagctgtgcacctttaccctggcaattgccctgggtgctgtcctgctcctgcccttctccatcatcagcaatgaggtgctgctctccctgcctcggaactactacatccagtggctcaacggctccctcatccatggtgtgtggctcctggaagctgcttggggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctt

SEQ ID NO: 149315 - DNA, 535 bp, Homo sapiens
  Payload ID: 9478
  Gene Symbol: LMBR1L
  Gene Name: limb development membrane protein 1-like
  ENST ID: ENST00000551854
  CDS Start-End: 112-535
gttgggggtctccggggtctgagagcctgcggagtctgccttagtctgataatcggggaaggatgggtttgcttctcaaactgggttgagggcaaactcagctgacgttggatgaaggggagacgtcgtcacactgagcttgattccagaaaagaggggaggtgtagggatggcagacgggaggaacctggggacttgatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagt

SEQ ID NO: 149316 - DNA, 1866 bp, Homo sapiens
  Payload ID: 9478
  Gene Symbol: LMBR1L
  Gene Name: limb development membrane protein 1-like
  ENST ID: ENST00000547670
  CDS Start-End: 323-502
aaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattgctgggttcccagcctctcagccattccggggtttccccagtgagtggtcctcccagggcttcagagggtacctggctgctgttccttacgccctccctgccacttagagcgacaactgaaccttgcgcacagaagtggactactcaattctgggatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcaggtaccaggctgccctcccaccttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttccccca

SEQ ID NO: 149317 - DNA, 581 bp, Homo sapiens
  Payload ID: 9478
  Gene Symbol: LMBR1L
  Gene Name: limb development membrane protein 1-like
  ENST ID: ENST00000547675
  CDS Start-End: 121-581
gtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatgtgtgtactccactgggtctcgcccgcatgttctccgtcactgggaagctgctagtcaagccccggctgctggaagacctggaggagcagctgtactgctcagcctttgaggaggcagccctgacccgcag

SEQ ID NO: 149318 - DNA, 2235 bp, Homo sapiens
  Payload ID: 9478
  Gene Symbol: LMBR1L
  Gene Name: limb development membrane protein 1-like
  Uniprot ID: Q6UX01
  ENST ID: ENST00000547382
  CDS Start-End: 296-1705
ctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgttttttt

SEQ ID NO: 149319 - DNA, 771 bp, Homo sapiens
  Payload ID: 9478
  Gene Symbol: LMBR1L
  Gene Name: limb development membrane protein 1-like
  ENST ID: ENST00000551169
  CDS Start-End: 1-119
tctgccacatcttcctgacccgcttcaagaagcctgctgagttcaccacagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctggtgatggtggcctttctctttatggggagcctgatggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctgggtgagtgtac

SEQ ID NO: 149320 - DNA, 768 bp, Homo sapiens
  Payload ID: 9478
  Gene Symbol: LMBR1L
  Gene Name: limb development membrane protein 1-like
  ENST ID: ENST00000553040
  CDS Start-End: 1-557
agaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagaggagcctaagcactgtgctatcctggaggggctttggaccacctgaaagaccaaggggatagggaggaggaggcttcagccatcagcaataaagttgatcccagggt

SEQ ID NO: 149321 - DNA, 905 bp, Homo sapiens
  Payload ID: 9478
  Gene Symbol: LMBR1L
  Gene Name: limb development membrane protein 1-like
  ENST ID: ENST00000547698
  CDS Start-End: 1-378
ggcctgtctgtgctcattgtggccatccacatcctggagctgctcatcgatgaggctgccatgccccgaggcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttt

SEQ ID NO: 149322 - DNA, 541 bp, Homo sapiens
  Payload ID: 9478
  Gene Symbol: LMBR1L
  Gene Name: limb development membrane protein 1-like
  ENST ID: ENST00000550815
  CDS Start-End: 123-347
ctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtttcatcctacaaaatgggcgtaacaatgtctacctactccattgtgtggaccaaaggagatggttaatgtgaaagccctttgtgaacctgaatggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcat

SEQ ID NO: 149323 - DNA, 529 bp, Homo sapiens
  Payload ID: 9478
  Gene Symbol: LMBR1L
  Gene Name: limb development membrane protein 1-like
  ENST ID: ENST00000550137
  CDS Start-End: 291-529
agcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacaggcctctggaaccttgtttttctcttctccaacctgtccctcatcttcctcatgccctttgcatatttcttcactgagtctga

SEQ ID NO: 149324 - DNA, 567 bp, Homo sapiens
  Payload ID: 9478
  Gene Symbol: LMBR1L
  Gene Name: limb development membrane protein 1-like
  ENST ID: ENST00000551782
  CDS Start-End: 188-567
agatctcttaaaaagatggaccctcagcggcgcttcctcgtagcgagcctagtggcgggtgtttgcattgaaacgctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcct

SEQ ID NO: 149325 - DNA, 560 bp, Homo sapiens
  Payload ID: 9478
  Gene Symbol: LMBR1L
  Gene Name: limb development membrane protein 1-like
  ENST ID: ENST00000549296
  CDS Start-End: 296-445
ctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatg

SEQ ID NO: 149326 - DNA, 277 bp, Homo sapiens
  Payload ID: 9478
  Gene Symbol: LMBR1L
  Gene Name: limb development membrane protein 1-like
  ENST ID: ENST00000552449
  CDS Start-End: 1-277
gcctggcaacggaacctgggctaccccctggctatgctgtgcttgctggtgctgacgggcctgtctgtgctcattgtggccatccacatcctggagctgctcatcgatgaggctgccatgccccgaggcatgcaggttgtactcatcttgtatccttctggaaacccatcattgcctctgttcagcaaacctgtctcctgggactctagaccgagcacttcttggactttttacctaatggtgtcctcagttgtgggcttctatagctctccactct

SEQ ID NO: 149327 - DNA, 1561 bp, Homo sapiens
  Payload ID: 9479
  Gene Symbol: LSAMP
  Gene Name: limbic system-associated membrane protein
  ENST ID: ENST00000333617
  CDS Start-End: 1-1038
ctgagattgctctgccttcttcccacaggactgcctgttcgcagcgtggattttaaccgaggcacggacaacatcaccgtgaggcagggggacacagccatcctcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcaaacgtgttttacccacaatcccccaccccattcaagaaattggtaccaccgtgcacttcaagcaaaaaggacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcaggatggagaaggttctactgggatatgtttatatctactaagcaaatgtatgctgtgtaaagactacaccacactaaggacatctggatgctgtaaaaataagagaagaaccagatggatattaagccccccaacacacactttatccttccttccttcatcttttttcatctgtggggaagaaaataaggtcttgcctttggtgtttatatttccataaccttttaattctatttttcatttgagctgacttgtagccacttcagactatcaatggaatcttatgttgagcctttctctg

SEQ ID NO: 149328 - DNA, 772 bp, Homo sapiens
  Payload ID: 9479
  Gene Symbol: LSAMP
  Gene Name: limbic system-associated membrane protein
  ENST ID: ENST00000474851
  CDS Start-End: 157-772
aatcatgggggcaggtctttcctgtgctgttctcatgagagtgaataagtttcatgagatctgatagttctataaaggggagtttccctgcatgagctctccctttgcctgctgccatccacgtaagatgtgacttgctcctccttgccttctgccatgattgtgaggctcccccagccatgtggaactgtaagtgaaaagatatcttctgaagtgttctccagaaactgtgcaggtggcggttctcttagaagaaaaagaaaggcagggatccttgaaatggtaatatttcagttgtttcatatacatagaagtgtctcacatggccagcaaggactgcctgttcgcagcgtggattttaaccgaggcacggacaacatcaccgtgaggcagggggacacagccatcctcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactg

SEQ ID NO: 149329 - DNA, 9446 bp, Homo sapiens
  Payload ID: 9479
  Gene Symbol: LSAMP
  Gene Name: limbic system-associated membrane protein
  Uniprot ID: Q13449
  ENST ID: ENST00000490035
  CDS Start-End: 501-1517
ggggagagaggctctgggttgctgctgcttctgctgctgctgctgctgtgtggctgtttctgtacactcactggcaggcttggtgccggctccctcgcccgcccgcccgccagcctgggaaagtgggttacagagcgaaggagctcagctcagacactggcagaggagcatccagtcacagagagaccaaacaagaaccctttcctttggcttcctcttcagctcttccagagggcttgctatttgcactctctcttttgaaattgtgttgcttttacttttcacccttctgcttgggttttatgagggctttgttaagtcttagagggaaaagagactgagcgagggaaagagagaggcaaagtggaaaggaccataaactggcaaagcccgctctgcgctcgctgtggatgaaagccccgtgttggtgaagcctctcctcgcgagcagcgcgcacccctccagagcaccccgcggacccgcacctcggcgtggccaccatggtcaggagagttcagccggatcggaaacagttgccactggtcctactgagattgctctgccttcttcccacaggactgcctgttcgcagcgtggattttaaccgaggcacggacaacatcaccgtgaggcagggggacacagccatcctcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcaggatggagaaggttctactgggatatgtttatatctactaagcaaatgtatgctgtgtaaagactacaccacactaaggacatctggatgctgtaaaaataagagaagaaccagatggatattaagccccccaacacacactttatccttccttccttcatcttttttcatctgtggggaagaaaataaggtcttgcctttggtgtttatatttccataaccttttaattctatttttcatttgagctgacttgtagccacttcagactatcaatggaatcttatgttgagcctttctctggctttccttcctccactatctctccaactttagagatcatcccctctccctccagtgcgttctatctcccccacacccaccctagatactcccttttcacccacctttcctccctcacctctcctcacctccaccccctccccagagcactagtcatgccgcaaatgctaggaagtgccattttcattttctccactgtgcgtgtgtgctcaagtctttcgctctcacgtgggtgtacatgtgtgtgagcgtgtgtgtgtctctctctaaagcatgccaagggaatggtccatgtgtacatagactcattgtgctgtagatactgtcctgcattgtaattgtgagatgcggctgtaacaagttgctgggggagatggcggggaaagaggcaaggagcagagtcctccctacatccatggctgtcacatggcatcagtgtgtattcaaaccaagctatgctccttccaagggcaggaccccatattcctcctagtcccatcatcagaaccgagtggggagtcactcagaatatcactgtaaatgaaagtgcctactatcgatggggtaagcaaacagcataaggaattatgacgtggacgaggtgacctaggagagaaaatttcagattttactctcatttcatgagtctgagggattcttatatttcctggcatttaacagggtaggccctgctccactgtgaaaatgagcagcatgtgttgagtaaatccccagaaacaggaaggtctccaagtgtcaactcccagtgaaagaatgatgaaccacttggagatcctaagcagccctgttttacctcctccctaatcttaaataacatttgtcccatgaattcccctgagcagagattgtttcctatttcagataaaatacagtgaaagtgagcaaggcagaaaaagtcaacagatgcccaggctcctactgtattctggagatactgtcagagctctaatacagagcactggccataatgaaaagcagttcactccttgtgctcctctgcagatgtttttcccagtgttctaggttaatgttttatttggttgcctgcataatccctgttctgtttcactgatggtgtttgcagcaccactgttcatggtggtccactgttatcctatgccagggtgctaagaattgcatgatattcatcttccctgctctatttaaatttacatctataagagtcatcttgacattaacactgaaatgtgatctaggtccttaaccaaaattgctgggcaacttgtaataaatttagacagaaattttatgagtaccacaaagcttggtgttaccacatcaccagaaggatttcttaggaaatgtcttgccgagagagctggctctctgcatatagatgtctttgtcagaaaaccaacccttgctctcacttacacagtagtaagcactgaaagtggttcagttcatgagaggacagagaattattttgagattatatttgaatgtaatcttgcagagccaaatatggtatgtcattaagttggaaccttgtaaatagctgttccatgttataaaatgagaaactttgtaactggaaaaaaagaaaggaaagaaggaaggaaggaaggaaggaaggcagggagggggggacggggaagggggggagggagggagggagggagggagggagggagggagggaggaaggaaggaaggaaggaaggaaggagaaaggaaaggaaggcaggagggagaaagatctaagtagcattgttaatttcttcaatttcttctaagggattttattgtttgttttagaagcttatcacagccttctttcatgattttgcagtttagacttgatacaaggaaaaattcagcttggggatggttaagagtgtttatagcagattctgacataggagagaaaacaaattctcatccaagaaggtagctagtaaaatatagggaaggtgagccatattcctatgcagcatcaatttattgacaatcaggtatttctcttaacagtttggtcttcttagttcaagaataaagggtatcatctttaataataagcattccccaaaaattgaagaggcagtcacacacttaagtgtgtggctttagaaaagcgcatgctaatttaaagatatacaggaagagaaaagtaggagttaagttggatgttgttagaagttggatgttagtattaccttcaggaacagatccccatggcatgtcacaggccttaattatatacctggctttcttattgtctccactttatcatgaggacaaggtcttggtttcatgggaggaacttctccattgaaataaatgtctgccatgtcagcaccgtttgttccctcagttttaatataatggaccatatattaaacataattaaacatatatttaaatgtggtgtttgcctgtgtctctagcaggatcttgaaattttaaaaatttgcttctggttcctgtttcagagaaaacattgtccccagaaatttcataggattgaaagtgttccctaagcagtgtgaacaatggaggaaaatatagtttagagaaaagtcagggaaaggtagggccagaggactgacaccaagaaatcattgaatctcaacataagacttcttggaatttagttaatcatattggaataaattccttcaagaatcttgtcccttggtaatcaaagtttgaaaccccgcactgaaaagcaccaactggttggaaataatatactgagaggagtgaaattcatcaattaatctgagtggctaatatatttaatatcctttgtatacaaagtaaaactccaccattcgtaaaaggaaatccttagacccaactttcagttaacaaaaacagaaatgactttgacccagggtgcttcctgaagaatgagaactatccagggctttacaactgcagaattgtaattatgctctgtgcaattgttgagcaaaggttttgccttgctggataaaaagtcttgtttgtttcgagacatgaaatccccatgtcttaaaagaactaaggcttatagaaaagcagatgggttttctctcaggaaggactgccccattgacctttgccttctcttccaagtcagacagacttctcgcttgccatgggcatttttttactacatagtcagactactggggctacttatagagaccttgtaaaagtactcgtgattttcacgttcttggaggaccaaacaaaaatctgtttctcctccaaaaatggacttacctcctttgcacacaaaagctaaactcctcagcatgaaattgtttgagttattactttaccaagttgtgagcttcttgaatcctccagagtcgcagattccatccctgagttggttgtggtttcactgtttctattggctattctccctgaatttttcattttgttctttgcagggctcgaattatttgtggaaaacaataatatatatgtgtgtgtattttttatctttatagatgctatatttacaataatgtatgtattataagacaaattaagaataatgttttgatcttaaaaggaagaaaagtactgaatttggttgtttagaaagaaaatctatgctcacgtagaaagacatagagccccactttttccgttttgtaattatttggcgaaaagaaatttgcttatagactatgtttaatgggattaaccatgtcctcatttttcttttcatcctcatacacttttagcctgcatttagtcttggttaccaatatcattttttaagagaaatgtaagtacagtgctatatcttacctacataaactattaatattttgaagacaaatgtgaaacacaccacaaaaatggtgagataagaaacaaaaatgcagtttaggaagcctcctccttgcttaaatgtttagaatatttcttctccaaagactgcatttgcctcagtgatgtaaattttccatcatggttggcataatatctgtaaacatctcactaaatgcaaaatggagtttacatttatgtgcatactagcagaaaagaagtaaactattctcatttgcatgtagctatgctgttcaaatgtcgccaaccaaaatttaggaaagaatttgttttcacccagcatgtacatctcacttttctcttggcaaggaagctggtgttaacgttgggtttaggtttaacatttacaccagcgaaaatgtttatgaatattatggaaaacttattttaaaccttgatttcttttgagcacatttacatgctgcgtgctgattaataaattaggcaccaatcatgtgtaaatcaatgtaaatcactagtttatgtacataatataaactatgtaaacttcatttttcatgcagtgcccaactactgctaaggtttactatgattcttaaggaaaaaaaaatcaaataaaaataaataaaaactgaaacgtttcacagttcagaatcggaagaattacgactaaagctccaaatatgaggttgccttagccaaaggaagcagacccacaggaacagttcaaggtttatatcctgctcaagtcacctctttggtctttcaggatctaagtggagattgtcccaactgttgctgtagttgtctcacccgaccccaaagcaagggaaatagagggaaaggttttaagggctatatgtctgctgtatccactcccagctatcttctttttactcctttctcaccatctaagatgtcttatttaaatagctccaaggaagtgacctaaaccttgatgagcaaaatattactcagtttttattttccattcaacaaaagcagtgggaaagcttgccatctggattctaagaaattgtgcaatataaaaaatgttatatcctcgagaaatatcttgctgagtcaccctaggaaataactaccttttatttatctggtagcctaatgtttccacacatttatcctgaatattgcaagtgagggactgaatcatttttaattgggagttatctttctcaggcatgttctcttggagtctttttgaagtgcctgacacgtgtaacaggatgacatatatatcattcctacaatatgaacaactgttacataaaaaattatcaaggagatgatttcaggaaacaagtgaactttctgcaaagacttataaaaattttaggtcaaattaacttcaggctttaaatgcactaatctacctaagagaaaaaaaaagaaaaaaaacaggaaggagttttaagggctcatgtgcctgttgtatcaacccccaagtgtcttcttggtactgcttcctcatcatctaagataaactgacaactttaaagtgaggtagaaggtgtattgaattgggagtcaggagaattgggttctaaccccaagttcagccacaaataaagctgtgagacattggcaagtcatttaactttcctgagtcttggttttctcatcctgaaagtgagggattcggctgacgtctctaaaatctctttcaactctaacctttattctgaataagaatttaatattcacttagtgctgtgcccagcactgtttgtaaacagcagctgtttgttatctctagtttggtctctgtattctcatcacttctcagaactatcattctaccgtcttcatttctaaacccaaaactgctagaatacagggactctggactgggtctgtaaattttttctgatcaaaactttatagcagtgtagagaagggacacattcaaattacactaaggacattgacatagctggggttgtttccttgtttatattataaaacctaaatgtggaactatattctaataatctttcataggaaggaaaatagccagactgggtattatgcatgtaacaaatgaggacattgtgcataagaaaggaaacattagttttctgtcatcctgggccaagtacctcattacagtaaatgtgtgtctttggaaactctttgcttgtgctgatggcggtaagcatggggtcccaggcaggttcaaaggctgaactgtaagaaatgggcaagacaatacattttgttttggaaggaatttctcatgggataagtttcccaaagcttgaattataggctatgaaataaagcaaatagatggagagaaaacaagtattgttttcaaaaagtacaagtcaattctatttaaagaagacaagctgaaaataaaacaaaaataaacacaatttaggaggttacagagttgaagacagtatgaattgttgtgaaggccaaaatcaaatgtgaaagttaggttctctgagaaaagggtaagcagaaaggatgatttctcaagcaattaataaggaattattttcttgtgccatgttctagatgcattgagcacagatcctcttgtcctaagctgtcctagaggctcaggttagcatctatccaaagttgtcctttgattttattgtctgaaagaacagaaggcatcagagtttccagtcactgaagagtagggtttgttcatcacttcccagcaatcacatcactttgtgtaggtaaggatatatgatgtgcttagattacttatgaagctctctctaagtgggagaatgacctgtccatgggacaactccccgttttcatggtcatttcagaagtacctctttttgggcagtgctcctggatctacttctacagccacattctactctgcacaatcctccctatgtaaagccaggcacagtacaaatatgcttcttgcaagtgaagaaaacccatggaagtcctagcttcatggcacgctgcagcaatcccaagctaccaggagcctcttttgaacccacttccctaagtctttgctcttcaccagagaatggaaattgttcatcctggtgaactgtggccaagttctgctccctaagtatttacttggagtagggaggttaaagggaagaaattcagggggagagaagcaaaagagaacacttccaactccctcccccatctcccaatgctccccaccttccttatcactgctctactgaagggtgtataaatcctgctcttggttagaattctccttattaacagtgttatatacatataaatatatatataaatatattccttttttcagccctgtagacatgaactgatcttcccttgaagatacaaacacatggccattttttgtttgggattttttgtttttcaaggtttttcatttttgtttattaggtggatttttttccctgggtactagctctgtgaaggagataaaaagcgcaatgtgtgttaaaaaaaaaaaattaaaattaaaatgaaaaaaagctttttttcttttctttttaaatgtatttaaattctgtttctctcttctgttactttacacgtatgaatgctctgctcttctgtgatcttaaaacaaaatgaaataaacgtgaaaag

SEQ ID NO: 149330 - DNA, 8821 bp, Homo sapiens
  Payload ID: 9479
  Gene Symbol: LSAMP
  Gene Name: limbic system-associated membrane protein
  ENST ID: ENST00000539563
  CDS Start-End: 1-867
gtcaggtgcgttgtagaagacaagaactcaaaggtggcctggttgaaccgttctggcatcatttttgctggacatgacaagtggtctctggacccacgggttgagctggagaaacgccattctctggaatacagcctccgaatccagaaggtggatgtctatgatgagggttcctacacttgctcagttcagacacagcatgagcccaagacctcccaagtttacttgatcgtacaagtcccaccaaagatctccaatatctcctcggatgtcactgtgaatgagggcagcaacgtgactctggtctgcatggccaatggccgtcctgaacctgttatcacctggagacaccttacaccaactggaagggaatttgaaggagaagaagaatatctggagatccttggcatcaccagggagcagtcaggcaaatatgagtgcaaagctgccaacgaggtctcctcggcggatgtcaaacaagtcaaggtcactgtgaactatcctcccactatcacagaatccaagagcaatgaagccaccacaggacgacaagcttcactcaaatgtgaggcctcggcagtgcctgcacctgactttgagtggtaccgggatgacactaggataaatagtgccaatggccttgagattaagagcacggagggccagtcttccctgacggtgaccaacgtcactgaggagcactacggcaactacacctgtgtggctgccaacaagctgggggtcaccaatgccagcctagtccttttcagacctgggtcggtgagaggaataaatggatccatcagtctggccgtaccactgtggctgctggcagcatctctgctctgccttctcagcaaatgttaatagaataaaaatttaaaaataatttaaaaaacacacaaaaatgcgtcacacagaatacagagagagagagacagagagagagagagagagagagatgggggagaccgtttatttcacaactttgtgtgtttatacatgaagggggaaataagaaagtgaagaagaaaatacaacatttaaaacaattttacagtccatcattaaaaatttatgtatcattcaggatggagaaggttctactgggatatgtttatatctactaagcaaatgtatgctgtgtaaagactacaccacactaaggacatctggatgctgtaaaaataagagaagaaccagatggatattaagccccccaacacacactttatccttccttccttcatcttttttcatctgtggggaagaaaataaggtcttgcctttggtgtttatatttccataaccttttaattctatttttcatttgagctgacttgtagccacttcagactatcaatggaatcttatgttgagcctttctctggctttccttcctccactatctctccaactttagagatcatcccctctccctccagtgcgttctatctcccccacacccaccctagatactcccttttcacccacctttcctccctcacctctcctcacctccaccccctccccagagcactagtcatgccgcaaatgctaggaagtgccattttcattttctccactgtgcgtgtgtgctcaagtctttcgctctcacgtgggtgtacatgtgtgtgagcgtgtgtgtgtctctctctaaagcatgccaagggaatggtccatgtgtacatagactcattgtgctgtagatactgtcctgcattgtaattgtgagatgcggctgtaacaagttgctgggggagatggcggggaaagaggcaaggagcagagtcctccctacatccatggctgtcacatggcatcagtgtgtattcaaaccaagctatgctccttccaagggcaggaccccatattcctcctagtcccatcatcagaaccgagtggggagtcactcagaatatcactgtaaatgaaagtgcctactatcgatggggtaagcaaacagcataaggaattatgacgtggacgaggtgacctaggagagaaaatttcagattttactctcatttcatgagtctgagggattcttatatttcctggcatttaacagggtaggccctgctccactgtgaaaatgagcagcatgtgttgagtaaatccccagaaacaggaaggtctccaagtgtcaactcccagtgaaagaatgatgaaccacttggagatcctaagcagccctgttttacctcctccctaatcttaaataacatttgtcccatgaattcccctgagcagagattgtttcctatttcagataaaatacagtgaaagtgagcaaggcagaaaaagtcaacagatgcccaggctcctactgtattctggagatactgtcagagctctaatacagagcactggccataatgaaaagcagttcactccttgtgctcctctgcagatgtttttcccagtgttctaggttaatgttttatttggttgcctgcataatccctgttctgtttcactgatggtgtttgcagcaccactgttcatggtggtccactgttatcctatgccagggtgctaagaattgcatgatattcatcttccctgctctatttaaatttacatctataagagtcatcttgacattaacactgaaatgtgatctaggtccttaaccaaaattgctgggcaacttgtaataaatttagacagaaattttatgagtaccacaaagcttggtgttaccacatcaccagaaggatttcttaggaaatgtcttgccgagagagctggctctctgcatatagatgtctttgtcagaaaaccaacccttgctctcacttacacagtagtaagcactgaaagtggttcagttcatgagaggacagagaattattttgagattatatttgaatgtaatcttgcagagccaaatatggtatgtcattaagttggaaccttgtaaatagctgttccatgttataaaatgagaaactttgtaactggaaaaaaagaaaggaaagaaggaaggaaggaaggaaggaaggcagggagggggggacggggaagggggggagggagggagggagggagggagggagggagggagggaggaaggaaggaaggaaggaaggaaggagaaaggaaaggaaggcaggagggagaaagatctaagtagcattgttaatttcttcaatttcttctaagggattttattgtttgttttagaagcttatcacagccttctttcatgattttgcagtttagacttgatacaaggaaaaattcagcttggggatggttaagagtgtttatagcagattctgacataggagagaaaacaaattctcatccaagaaggtagctagtaaaatatagggaaggtgagccatattcctatgcagcatcaatttattgacaatcaggtatttctcttaacagtttggtcttcttagttcaagaataaagggtatcatctttaataataagcattccccaaaaattgaagaggcagtcacacacttaagtgtgtggctttagaaaagcgcatgctaatttaaagatatacaggaagagaaaagtaggagttaagttggatgttgttagaagttggatgttagtattaccttcaggaacagatccccatggcatgtcacaggccttaattatatacctggctttcttattgtctccactttatcatgaggacaaggtcttggtttcatgggaggaacttctccattgaaataaatgtctgccatgtcagcaccgtttgttccctcagttttaatataatggaccatatattaaacataattaaacatatatttaaatgtggtgtttgcctgtgtctctagcaggatcttgaaattttaaaaatttgcttctggttcctgtttcagagaaaacattgtccccagaaatttcataggattgaaagtgttccctaagcagtgtgaacaatggaggaaaatatagtttagagaaaagtcagggaaaggtagggccagaggactgacaccaagaaatcattgaatctcaacataagacttcttggaatttagttaatcatattggaataaattccttcaagaatcttgtcccttggtaatcaaagtttgaaaccccgcactgaaaagcaccaactggttggaaataatatactgagaggagtgaaattcatcaattaatctgagtggctaatatatttaatatcctttgtatacaaagtaaaactccaccattcgtaaaaggaaatccttagacccaactttcagttaacaaaaacagaaatgactttgacccagggtgcttcctgaagaatgagaactatccagggctttacaactgcagaattgtaattatgctctgtgcaattgttgagcaaaggttttgccttgctggataaaaagtcttgtttgtttcgagacatgaaatccccatgtcttaaaagaactaaggcttatagaaaagcagatgggttttctctcaggaaggactgccccattgacctttgccttctcttccaagtcagacagacttctcgcttgccatgggcatttttttactacatagtcagactactggggctacttatagagaccttgtaaaagtactcgtgattttcacgttcttggaggaccaaacaaaaatctgtttctcctccaaaaatggacttacctcctttgcacacaaaagctaaactcctcagcatgaaattgtttgagttattactttaccaagttgtgagcttcttgaatcctccagagtcgcagattccatccctgagttggttgtggtttcactgtttctattggctattctccctgaatttttcattttgttctttgcagggctcgaattatttgtggaaaacaataatatatatgtgtgtgtattttttatctttatagatgctatatttacaataatgtatgtattataagacaaattaagaataatgttttgatcttaaaaggaagaaaagtactgaatttggttgtttagaaagaaaatctatgctcacgtagaaagacatagagccccactttttccgttttgtaattatttggcgaaaagaaatttgcttatagactatgtttaatgggattaaccatgtcctcatttttcttttcatcctcatacacttttagcctgcatttagtcttggttaccaatatcattttttaagagaaatgtaagtacagtgctatatcttacctacataaactattaatattttgaagacaaatgtgaaacacaccacaaaaatggtgagataagaaacaaaaatgcagtttaggaagcctcctccttgcttaaatgtttagaatatttcttctccaaagactgcatttgcctcagtgatgtaaattttccatcatggttggcataatatctgtaaacatctcactaaatgcaaaatggagtttacatttatgtgcatactagcagaaaagaagtaaactattctcatttgcatgtagctatgctgttcaaatgtcgccaaccaaaatttaggaaagaatttgttttcacccagcatgtacatctcacttttctcttggcaaggaagctggtgttaacgttgggtttaggtttaacatttacaccagcgaaaatgtttatgaatattatggaaaacttattttaaaccttgatttcttttgagcacatttacatgctgcgtgctgattaataaattaggcaccaatcatgtgtaaatcaatgtaaatcactagtttatgtacataatataaactatgtaaacttcatttttcatgcagtgcccaactactgctaaggtttactatgattcttaaggaaaaaaaaatcaaataaaaataaataaaaactgaaacgtttcacagttcagaatcggaagaattacgactaaagctccaaatatgaggttgccttagccaaaggaagcagacccacaggaacagttcaaggtttatatcctgctcaagtcacctctttggtctttcaggatctaagtggagattgtcccaactgttgctgtagttgtctcacccgaccccaaagcaagggaaatagagggaaaggttttaagggctatatgtctgctgtatccactcccagctatcttctttttactcctttctcaccatctaagatgtcttatttaaatagctccaaggaagtgacctaaaccttgatgagcaaaatattactcagtttttattttccattcaacaaaagcagtgggaaagcttgccatctggattctaagaaattgtgcaatataaaaaatgttatatcctcgagaaatatcttgctgagtcaccctaggaaataactaccttttatttatctggtagcctaatgtttccacacatttatcctgaatattgcaagtgagggactgaatcatttttaattgggagttatctttctcaggcatgttctcttggagtctttttgaagtgcctgacacgtgtaacaggatgacatatatatcattcctacaatatgaacaactgttacataaaaaattatcaaggagatgatttcaggaaacaagtgaactttctgcaaagacttataaaaattttaggtcaaattaacttcaggctttaaatgcactaatctacctaagagaaaaaaaaagaaaaaaaacaggaaggagttttaagggctcatgtgcctgttgtatcaacccccaagtgtcttcttggtactgcttcctcatcatctaagataaactgacaactttaaagtgaggtagaaggtgtattgaattgggagtcaggagaattgggttctaaccccaagttcagccacaaataaagctgtgagacattggcaagtcatttaactttcctgagtcttggttttctcatcctgaaagtgagggattcggctgacgtctctaaaatctctttcaactctaacctttattctgaataagaatttaatattcacttagtgctgtgcccagcactgtttgtaaacagcagctgtttgttatctctagtttggtctctgtattctcatcacttctcagaactatcattctaccgtcttcatttctaaacccaaaactgctagaatacagggactctggactgggtctgtaaattttttctgatcaaaactttatagcagtgtagagaagggacacattcaaattacactaaggacattgacatagctggggttgtttccttgtttatattataaaacctaaatgtggaactatattctaataatctttcataggaaggaaaatagccagactgggtattatgcatgtaacaaatgaggacattgtgcataagaaaggaaacattagttttctgtcatcctgggccaagtacctcattacagtaaatgtgtgtctttggaaactctttgcttgtgctgatggcggtaagcatggggtcccaggcaggttcaaaggctgaactgtaagaaatgggcaagacaatacattttgttttggaaggaatttctcatgggataagtttcccaaagcttgaattataggctatgaaataaagcaaatagatggagagaaaacaagtattgttttcaaaaagtacaagtcaattctatttaaagaagacaagctgaaaataaaacaaaaataaacacaatttaggaggttacagagttgaagacagtatgaattgttgtgaaggccaaaatcaaatgtgaaagttaggttctctgagaaaagggtaagcagaaaggatgatttctcaagcaattaataaggaattattttcttgtgccatgttctagatgcattgagcacagatcctcttgtcctaagctgtcctagaggctcaggttagcatctatccaaagttgtcctttgattttattgtctgaaagaacagaaggcatcagagtttccagtcactgaagagtagggtttgttcatcacttcccagcaatcacatcactttgtgtaggtaaggatatatgatgtgcttagattacttatgaagctctctctaagtgggagaatgacctgtccatgggacaactccccgttttcatggtcatttcagaagtacctctttttgggcagtgctcctggatctacttctacagccacattctactctgcacaatcctccctatgtaaagccaggcacagtacaaatatgcttcttgcaagtgaagaaaacccatggaagtcctagcttcatggcacgctgcagcaatcccaagctaccaggagcctcttttgaacccacttccctaagtctttgctcttcaccagagaatggaaattgttcatcctggtgaactgtggccaagttctgctccctaagtatttacttggagtagggaggttaaagggaagaaattcagggggagagaagcaaaagagaacacttccaactccctcccccatctcccaatgctccccaccttccttatcactgctctactgaagggtgtataaatcctgctcttggttagaattctccttattaacagtgttatatacatataaatatatatataaatatattccttttttcagccctgtagacatgaactgatcttcccttgaagatacaaacacatggccattttttgtttgggattttttgtttttcaaggtttttcatttttgtttattaggtggatttttttccctgggtactagctctgtgaaggagataaaaagcgcaatgtgtgttaaaaaaaaaaaattaaaattaaaatgaaaaaaagctttttttcttttctttttaaatgtatttaaattctgtttctctcttctgttactttacacgtatgaatgctctgctcttctgtgatcttaaaacaaaatgaaataaacgtgaaaaggagatgtgtcttcattgacctgtca

SEQ ID NO: 149331 - DNA, 3458 bp, Homo sapiens
  Payload ID: 9480
  Gene Symbol: LIN28A
  Gene Name: lin-28 homolog A (C. elegans)
  Uniprot ID: Q9H9Z2
  ENST ID: ENST00000254231
  CDS Start-End: 76-705
cctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagttttgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttcttttttttttttttttaaaatggagtctcactgtgtcacccaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgc

SEQ ID NO: 149332 - DNA, 4008 bp, Homo sapiens
  Payload ID: 9480
  Gene Symbol: LIN28A
  Gene Name: lin-28 homolog A (C. elegans)
  Uniprot ID: Q9H9Z2
  ENST ID: ENST00000326279
  CDS Start-End: 115-744
gtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagttttgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttcttttttttttttttttaaaatggagtctcactgtgtcacccaggctggagtgcagtggcatgatcggctcactgcagcctctgcctcttgggttcaagtgattctcctgcctcagcctcctgagtagctgggatttcaggcacccgccacactcagctaatttttgtatttttagtagagacggggtttcaccatgttgtccaggctggtctggaactcctgacctcaggtgatctgcccaccttggcttcccaaagtgctgggattacaggcatgagccaccatgctgggccaaccatttcttggtgtattcatgccaaacacttaagacactgctgtagcccaggcgcggtggctcacacctgtaatcccagcactttggaaggctgaggcgggcggatcacaaggtcacgagttcaaaactatcctggccaacacagtgaaaccccgtctctactaaaatacaaaaaaattagccgggtgtggtggtgcatgcctttagtcctagctattcaggaggctgaggcaggggaatcgcttgaacccgagaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaa

SEQ ID NO: 149333 - DNA, 5505 bp, Homo sapiens
  Payload ID: 9481
  Gene Symbol: LIN28B
  Gene Name: lin-28 homolog B (C. elegans)
  Uniprot ID: Q6ZN17
  ENST ID: ENST00000345080
  CDS Start-End: 204-956
aattgacaaagtcacgtgtgctcagggggccagaaactggagagaggagagaaaaaaatcaaaagaaggaaagcacattagaccatgcgagctaaatttgtgatcgcacaaaatcaagatgttagattgatgcagaagatcactccgttccaaagggaaagttttcatctcacgagtttggagctgagggcccgtggggcaacatggccgaaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagatagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactctccctcgagaagtgggaggcgggcatggctgtacatcaccaccgtttcctcaggaggctagggcagagatctcagaacggtcaggcaggtcacctcaagaagcttcctccacgaagtcatctatagcaccagaagagcaaagcaaaaaggggccttcagttcaaaaaaggaaaaagacataacaggtcttcttcatatgttctttcctttacccggttgcaaagtctacctcatgcaagtataggggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaatttctgaaacatctgcaagaaggtaccagttaattatagtgcttaatattgggaataagattaagcattataattataatgtatgggcctgttggtgtaagctcagataattaaataaaaatagcatgactcaaatgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagacgccaatgtccttcatttactgtctgtgctgccctgaagccaagcgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatggatatgttgaggtttaaaaaaattacttgattaaaaataaaacatataacgttggcattta

SEQ ID NO: 149334 - DNA, 1150 bp, Homo sapiens
  Payload ID: 9482
  Gene Symbol: LIN37
  Gene Name: lin-37 DREAM MuvB core complex component
  Uniprot ID: Q96GY3
  ENST ID: ENST00000301159
  CDS Start-End: 365-1105
tactcagggtgagtctgggaagctggaactacacctcccaggaagctagggggtagatggtttgtttccggaagcaaagccccaggtgggtgggacctaaagctgggagactacggaggcagctctcaattggtcaggatgcgagattgacggctgcaataactaataggaacaagctactgccgaaggggcccgcccacagaagggtggtggccacggtccaggctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataaggactgctccatcgcagccactggcaaaaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctccaca

SEQ ID NO: 149335 - DNA, 291 bp, Homo sapiens
  Payload ID: 9482
  Gene Symbol: LIN37
  Gene Name: lin-37 DREAM MuvB core complex component
  ENST ID: ENST00000587751
  CDS Start-End: 235-291
tcgggaccatcgggttgacagggtgtggagtcccggtggaagggagtatcgcggaaaggggactgcacgacttttccctgaagcccacctgacaatcgctgtatcaggcagcgagcgttgcctgccaccttcacaccctcccggtgtgcgcttgaagtcgctttgagattgaatggggtggctcgggcaatgacgtgcgtggtaggacatggggaatcctgagccgagctggagatggccaaagcccggaaccaactggatgctgtcttgcagtgtctgctggagaagagt

SEQ ID NO: 149336 - DNA, 532 bp, Homo sapiens
  Payload ID: 9482
  Gene Symbol: LIN37
  Gene Name: lin-37 DREAM MuvB core complex component
  ENST ID: ENST00000591163
  CDS Start-End: 1-491
ggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtccccccacaccagtaaacatcccccagctc

SEQ ID NO: 149337 - DNA, 1635 bp, Homo sapiens
  Payload ID: 9482
  Gene Symbol: LIN37
  Gene Name: lin-37 DREAM MuvB core complex component
  ENST ID: ENST00000595455
  CDS Start-End: 119-283
ggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcagagctggagatggccaaagcccggaaccaactggatgctgtcttgcagtgtctgctggagaagagtcacatggacagggagcgtctggatgaggaagctgggaaaacaccctcagacacccacaataagtgatcctgacactccctctccctacgcaggccatctgcccgcttcccccaccagcggaggaagaagaggagggagatggatgatgggctggctgagggagggccgcagcgatccaacacatatgtgatcaagctgttcgaccggagcgtggacttggcccagttcagcgagaacacgccactgtacccaatctgccgcgcctggatgcgcaacagcccctctgtgcgcgagcgtgaatgctctcccagctcacccctgcccccgctgcctgaggatgaggaggtgggatgggtagtgggtcccagcccagcagcctggtgccagggcagtgggtggataggctcaaaggatcctgcccctaagctagtgggatagacagacacaggtccctcacgtgaatcctggatcaggctaggcacacagatgtgcactcttaggttggggtgtggatcagagtccctagggaagacatacgtaaccacctggcctgggagacagggaacagggttaccctggacagttagatgtggacctccaagatcaggggttcccaagagccgaggggctagacaagggtccttagtacagacagaagtggccaccaggccttgaggagcaggggctgggcaggaatggatgggagtctataagccatctgacccagcggggtagacaagggtccccaggacagacatataggacccttcagacatataggactgtcagaaatggacagagcttcctaggtggcacagacgtgaccccctagacaggattccctgaggcaggcagacgcgactccctgggctgacaggtgtagatggagtctctgggctggataggagaagacaggggtccctggggcaggcacacttgacccgctggctggttgaggtgtctgcccttcatacatgcctcctgtctgagtcccttagcgagcccctcatgccatttgttgctgggaaaggcaggagggatgaatgtggattcccagcccctctgctttgactctcttgggcctggcatggggcccttgtgtccccagggctcagaggtaaccaacagcaagagtcgtgatgtgtacaagctgccgccacccacacccccggggccacccggagatgcctgcagatcccgcatcccatctccactgcagcctgagatgcagggcacccctgacgatgagccctctgagcccgagccctcaccctccacactcatctatcgcaacatgcagcgctggaaacgcatccgccagaggtggaaggaggcctctcatcggaaccagcttcgttactcagaaagcatgaagatcctacgagagatgtacgaacgacagtgatgttcccaggtcc

SEQ ID NO: 149338 - DNA, 2776 bp, Homo sapiens
  Payload ID: 9483
  Gene Symbol: LIN52
  Gene Name: lin-52 DREAM MuvB core complex component
  Uniprot ID: Q52LA3
  ENST ID: ENST00000555028
  CDS Start-End: 168-518
aacatccgcgtaaggggcgtggctatacttaggggcggggctaggcaaagattgccctatgaggcgagggaatgagactgggctgcgagttggggatagggtttctctttgggggcgtggcttatggaacctcgttttcccgccgacggttggccacgtcacgtgacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaaaagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacaaaagaatatcctggggccgggcatggtggctcacgcctgtaatcccagcactttgggaggccgaggcaggtggatcataggtcaaaagatcgagaccatcctggccaatatggtgaaaccctgtctctactaaaatacaaaaattagctgggcatgatggtgcatgcctatagtcccagctacttgggggcctgaggcacgagaatcgcttgaattcgggaggtggaggttgcagtgagccgaaattatgccactgcactccagcctgggcaacagagtgagactctgtctcagaaaaaaaaaaaaaaaaaaaaaaaaaaaaagaatatccctgtggcaatagtctgatggtgtttggacacaagaaaagttatggttttgagtcgtgagtgtttgctagggcatggcactcttcagtttaacagctgatccattaaaccttttctgacatttgtgccttgttctcatgctagaattaatgctggatttttctctcatttgaccatcaatgtagttttacttattgaaaggaaaaaagacttaacacaagataggaaagatgagtatgagaagtaaaacattctgctggggtgctacatagaaggttaggttgtaggggctttgattttaatttaaacttattatcgattgatatttctgtatctcactaaatgcggttgaagagtgtgtgtgtgtgtgtgcgcgcgcgcatgtggccaaaaaatagtgccataatgtcaaattcttcctttgctctgtttttgagagttgatgacatcaggcacttttcagtgtttggggaaattgattgggatacctcccccaaaccaactcaagtctgtaactggaagccaggtggttggttttctggtccgctttgtcctctttcttttaccgtcatcctattcaccagcacttaatgtaagtagatgttttagaattgcaatatttattggtttagtatttgtcatccttagaaatgttaatgatgtatttttatattgataatataaatttatgtacagtatgtgtgtatatgtatttcaggatgttatagtattgtactttgtatgtgatggtttttgtgtcttcataataaatatgtcccttttaca

SEQ ID NO: 149339 - DNA, 566 bp, Homo sapiens
  Payload ID: 9483
  Gene Symbol: LIN52
  Gene Name: lin-52 DREAM MuvB core complex component
  ENST ID: ENST00000554938
  CDS Start-End: 1-292
acgtgacatgggttggaagatggcgtctcccacagacgggacagatctggaagcatctttgctaagttttgaaaaacttgaccgtgcctcaccagatctttggccagaacaatttttgtttttctttttagtaccaggtgttgctgaatttgcagcttccttcaaaagtcctattactagttctccacccaaatggatggctgagatagaacgtgatgacatcgacatgttgaaagccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcat

SEQ ID NO: 149340 - DNA, 6127 bp, Homo sapiens
  Payload ID: 9484
  Gene Symbol: LIN54
  Gene Name: lin-54 DREAM MuvB core complex component
  Uniprot ID: Q6MZP7
  ENST ID: ENST00000340417
  CDS Start-End: 379-2628
gaggttactggtggtggcggcggcggcggcggcccgggctccggctgtcggggaagctgctgagctgtgatggtgatgacgaggtgaaaatggcggatctttcgaaatacaatcccggcccctgacataccagaggcggcggcgacggcgacgtcgccaccccggctcccttctcggtccccgggtaccctggagcgctccagtttggacaaactgggaaaggaagctgctggccagagctatcgtgcacgggcaaaacaagccccgccggggctcgggattgcccaggaccttctggagcccctacctcggagcccgagggaggagaaagcggcagccgctggagtgcctgatcaactttctagcgggagaacgatcatggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatcacttgagtccaggagttctagaccagcccaggctacatggtgaaaccctgtctctactaaaaatataaaaaaattcactgcgtgtggtggcgcacacctgcagtcctcgctactttgaaggcctgagcctgcagaggttgaggctgtagtgagtcaaaattacaccactgcactccagcctggcaatcagagtgagaccttgtctcaaaaacaaaaatacctagaaaatcaatctactctgtcttttaatgtgaaatgttcttatgatagctatctttcttagtttcctttttttctgaagcactaaacacaacctgtaggtcttatctctggggtctgggaaacagaaccttaatgttacaggtacaaaagcaaacagagtgattagttccccattttctggtagtgaacaactgacattttttcaatcttatgtaaaatgtgaataaaaataattttagaaaagttatctatttttattgttctgtaacacaaatagttaagaaaatgaatacttgttatgtaaatgaagcttcacagcaggacctccggccataactttgatcatgttgtatctcttaagcattttatataggaattctggtgtggctacccaaagcagaagggaaggcaatcaactaaaaatccctttctattggagttattttcatcatgtaaattacttcaggcttttcttgttagggcttcttgaatgcacattttgtcattatctgtataccaaaggtgagcttttttttttaatccatgtgattttatgagttgaaagctataaggttttttttaattaaaaatttccttctaaatggcaaa

SEQ ID NO: 149341 - DNA, 4254 bp, Homo sapiens
  Payload ID: 9484
  Gene Symbol: LIN54
  Gene Name: lin-54 DREAM MuvB core complex component
  Uniprot ID: Q6MZP7
  ENST ID: ENST00000442461
  CDS Start-End: 281-1867
ctttcgaaatacaatcccggcccctgacataccagaggcggcggcgacggcgacgtcgccaccccggctcccttctcggtccccgggtaccctggagcgctccagtttggacaaactgggaaaggaagctgctggccagagctatcgtgcacgggcaaaacaagccccgccggggctcgggattgcccaggaccttctggagcccctacctcggagcccgagggaggagaaagcggcagccgctggagtgcctgatcaactttctagcgggagaacgatcatggaggtggtgccagctgagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaa

SEQ ID NO: 149342 - DNA, 4083 bp, Homo sapiens
  Payload ID: 9484
  Gene Symbol: LIN54
  Gene Name: lin-54 DREAM MuvB core complex component
  Uniprot ID: Q6MZP7
  ENST ID: ENST00000446851
  CDS Start-End: 110-1696
actggtggtggcggcggcggcggcggcccgggctccggctgtcggggaagctgctgagctgtgatggtgatgacgagtgcctgatcaactttctagcgggagaacgatcatggaggtggtgccagctgagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaa

SEQ ID NO: 149343 - DNA, 2257 bp, Homo sapiens
  Payload ID: 9484
  Gene Symbol: LIN54
  Gene Name: lin-54 DREAM MuvB core complex component
  Uniprot ID: Q6MZP7
  ENST ID: ENST00000510557
  CDS Start-End: 129-1715
accctggtctgtgtctcggaggcgccgccgccgccgctgctgctgggagcccagggagcgccgcgcgaccaggaggcggcggcgccgccggctttgtgcctgatcaactttctagcgggagaacgatcatggaggtggtgccagctgagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcacttt

SEQ ID NO: 149344 - DNA, 4507 bp, Homo sapiens
  Payload ID: 9484
  Gene Symbol: LIN54
  Gene Name: lin-54 DREAM MuvB core complex component
  ENST ID: ENST00000510877
  CDS Start-End: 371-559
tggtggtggcggcggcggcggcggcccgggctccggctgtcggggaagctgctgagctgtgatggtgatgacgaggtgaaaatggcggatctttcgaaatacaatcccggcccctgacataccagaggcggcggcgacggcgacgtcgccaccccggctcccttctcggtccccgggtaccctggagcgctccagtttggacaaactgggaaaggaagctgctggccagagctatcgtgcacgggcaaaacaagccccgccggggctcgggattgcccaggaccttctggagcccctacctcggagcccgagggaggagaaagcggcagccgctggagtgcctgatcaactttctagcgggagaacgatcatggaggtggtgccagctgagattgctaagaagcctcgaacgccaacctctggtccagtaatcacgaagctgatctttgcaaaaccaattaatagtaaagcagttacaggacagacaactcaagtttcaccaccagttattgcagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatg

SEQ ID NO: 149345 - DNA, 2757 bp, Homo sapiens
  Payload ID: 9484
  Gene Symbol: LIN54
  Gene Name: lin-54 DREAM MuvB core complex component
  Uniprot ID: Q6MZP7
  ENST ID: ENST00000506560
  CDS Start-End: 259-2241
cctgacataccagaggcggcggcgacggcgacgtcgccaccccggctcccttctcggtccccgggtaccctggagcgctccagtttggacaaactgggaaaggaagctgctggccagagctatcgtgcacgggcaaaacaagccccgccggggctcgggattgcccaggaccttctggagcccctacctcggagcccgagggaggagaaagcggcagccgctggagtgcctgatcaactttctagcgggagaacgatcatggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgatt

SEQ ID NO: 149346 - DNA, 2742 bp, Homo sapiens
  Payload ID: 9484
  Gene Symbol: LIN54
  Gene Name: lin-54 DREAM MuvB core complex component
  Uniprot ID: Q6MZP7
  ENST ID: ENST00000505397
  CDS Start-End: 168-2417
gcggcggtggaatggggctgggcgcgtgattttgaacaaaccctggtctgtgtctcggaggcgccgccgccgccgctgctgctgggagcccagggagcgccgcgcgaccaggaggcggcggcgccgccggctttgtgcctgatcaactttctagcgggagaacgatcatggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacagattgctaagaagcctcgaacgccaacctctggtccagtaatcacgaagctgatctttgcaaaaccaattaatagtaaagcagttacaggacagacaactcaagtttcaccaccagttattgcaggtagggttctttcacagtctactcccggaactccatcaaagaccataacaatatctgaaagtggtgttattggatcaactttaaattctacaacacagacaccaaataaaatagccatctcacctttgaaatcgccaaataaggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgt

SEQ ID NO: 149347 - DNA, 2684 bp, Homo sapiens
  Payload ID: 9484
  Gene Symbol: LIN54
  Gene Name: lin-54 DREAM MuvB core complex component
  Uniprot ID: Q6MZP7
  ENST ID: ENST00000508171
  CDS Start-End: 260-991
ccctgacataccagaggcggcggcgacggcgacgtcgccaccccggctcccttctcggtccccgggtaccctggagcgctccagtttggacaaactgggaaaggaagctgctggccagagctatcgtgcacgggcaaaacaagccccgccggggctcgggattgcccaggaccttctggagcccctacctcggagcccgagggaggagaaagcggcagccgctggagtgcctgatcaactttctagcgggagaacgatcatggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacaggtagggttctttcacagtctactcccggaactccatcaaagaccataacaatatctgaaagtggtgttattggatcaactttaaattctacaacacagacaccaaataaaatagccatctcacctttgaaatcgccaaataagcaaagccagtggttgttaatacaaccccagtgcggatgtcagttccaattgtctcagctcaggctgtcaaacaagttgttccaaaaccaatcaatccaacttcacaaatagtaactactagccagccacagcaacggcttatcatgcctgccacaccactgccacagatccagcccaacctcactaacctgccaccaggcactgtcctggcaccagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaaattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgatt

SEQ ID NO: 149348 - DNA, 989 bp, Homo sapiens
  Payload ID: 9485
  Gene Symbol: LIN7A
  Gene Name: lin-7 homolog A (C. elegans)
  ENST ID: ENST00000261203
  CDS Start-End: 59-364
tccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggtattctcgtgtgtacactgtaagagaatttagacatcagtggcagcccagagtctagaaccagtactacttctcaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaa

SEQ ID NO: 149349 - DNA, 6112 bp, Homo sapiens
  Payload ID: 9485
  Gene Symbol: LIN7A
  Gene Name: lin-7 homolog A (C. elegans)
  Uniprot ID: O14910
  ENST ID: ENST00000552864
  CDS Start-End: 204-905
cggatacctgctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttttaaataaatcaccagggccaagattgagtgaatcttgggtccatagcttttccagatattagcaaacccctcattaggctataattcaaactgcatcagttcaaagtgaaacctacacattgctccttaccctcacctgctccacaatccatagtgctgagttgtctgaattggaattccagttaattgcaagttcaacctgttttcctcttgaaaatcgcaaggtatcatactatatttatattttcttcaggttctagaagcaatcggctttttcttttgtttccatgaattttattatgcattaatagaatggaccaattttagctcaacttttagtttgttagaagcaagtgtaggaactctagcactgtagtttttaattattgcttgtatctattattattaattccaacagagtataatgtatatttattctataaaatatatattatcagagtgcatttgttacaacttaggttcttttcttaccaagtattaagaatctagtaagagaatactagcaaaggacctagccctgtgaacagattctcgtatgttatatacataaacccactctcaatattttttgagttttatactttttgattgataaacactgaagaaatctaaactctactcacactgatgtgctgtcatagaagcctatttcatattttaaagcttagcaaaactaaattatatgtgcatatatattcaaatatttgtgtcacacaaagtttaggtcaatttccccaaatataaaccagatatttttggcactctcagataaacaagtattatttctcttataattgggcaggtggaaaccagtgatatcaatattgtgaatggcagatgctgcttcctctagaaaaataaaataaaatcaccaactttaatatattcccataggtaaatagacaatgagatatcatttttcagaaaatatcattcactggaaaataatctgttataactacatttacaggtcataatttttggtttatggtaaatctaggcacctaagtctgattttactttatgaaataaataggaagcaataattgtttgggcatttgaataccttaagcacataaatgaacctaagaaaagaataattgcttagttgaagtattcaaaatagatcagtaaaccacaggcaaatatttgaatgttcccttttctcaaatacagaaattgattccccaagatacaatacaatttgacacttcagataatcccccaaaatagaaatgtatgaagctcagtttagactgtcttcttgaaaataaaacaaaaccaatcaaaactacccagcacattttattatgccctgttgggtgatagtattgtcaataccaggttttccctgctcttcacaatgcatccctcaccagaggaaaaacagcaagaaaactaggacatttgctaatttcaacaatacacccctgtgataacagattcccatccttgaatacatatcattttttactagagagaacgggggtggtgaggtgggggcagttaggaccctgtatgttatgtaaaatagatttacaaaaaggacaagcatgataaaagggaatgaatggagacgatgtattattcagtttgaaagagatagttcacatttttataagaaaaatttaataaaacatatattttagttatcatttaacaaagatatattaaagctattcaggcaatgccacaggattctcatgaagggaaatcactgaacccttgtcatgagaaaatggtcatttcaacacatttcaatacattgtataaatttggagcttaaggtgagtgagtatgttttcacttagtcataaatgtttggtcaaaattaaagttatcatatggtttcacatcaatacaaatattgtcacagtgttacagaaacaactatcaaatggtaagatagtttacatttgtgttttctagaaacctttgtatttatgcttcatttggttaatgttaagtgctgataaaggcataccagattgtttgtcaaagtaaagaagcaatccatcacacctaggacatctaaggatggattatacgtcagagtggtctcatatacaaatgaccattttccttcagtaaaatcttgttggttgaaatgtaagtcttttcctaaagttttaatcagaggtagccatcactaagacttaagccacctgtggttctcttaagtttcactgaagccagaagaaggaaattaccacaacttgtattatactaattatcttcattattaacgatcatattagagccactgacatgtcccaaattatattaaaataaaaacctgcattgctctgacatgaagctcaattcaatgtaataaacaaattaggtattaaacgttataatttaaaaaacttctacgatatcaccagaaatcctggtgaaatttaattttttcccttttttaggtcagtggccggtgggatagatttttctaaactttttcctgctatgattttgaaggcaaatacatagagcacagttcagtaaaagagtttccaagccttttcactggagcatttacattttgattctgttgtcatttgaaatagaacatctgcagggagataatgagcttaagttacaattgactttggaaagaataacagacttttgtgtttcctcaatcatgtagtcaatagggaattctccagttatgtgaacaatcacagtcttttaagacaatacttagatctaaatgcaaaatctagcatgcagaggctttttaaggattttagactgtctccaaagaacttggctcgagatggattacacagatttacaaatgcagttttcaactgtgacatcaaactgatcttatctcatttcatgttactcaactgtgcccgtaggaccccaagaggtggaatattttgtctacattattttaaacatctatagatatgtgtggatgtgtgaataatgcctaaatttctcatcttttaactagtttgtttttatcatacagacacagcctgttcataagaccagctttagacaacttagaactcaatgctctgaagattcagggaggccaacatagaaaaagatcttccaaaatatggggtggtccaacccatctcatccctctctagctggaaaactatagagaaagggctgtgactgccttgaccactgcctggcacaatgtaggcactcggtatttgttggatgaataagtggctgaatcagtgaatagacaaaaaacatggattttgccttctgaaaatctcacaaattttaccagcttatattatactgattgtcactatgatttctaagtttcatggttagaaccatattttgagtctatataaaaactttttagatgtatgaatttgaaatttcattaattactttaaaggcttcaaagatttgaggacatttgaacagtggataaggaacaatgtttggggatacagagtttttatgctgagttgaactcaacctttctagttctttatacaagcttcctgaattatctggcaggaatgattcaaacataaaaccccatttttaaattttataaaagatattttcatttttatataaaaagatcatcaggcatattatcccctttgatatttattaacaaccattctctaagaaattcataataattggagacaccatccctaaatctcttcctattttcaaaagatcatttatcctttcatatttgattcctggaatacactaagctgaagtttaatcacatacttactcagatgtttccatgtgtttattcatttaacaaatacttattgtgtacctagtgcatgctaggttctggaaatgcaacagcaaacaagacagacacaatccctcttggaggttactgtgagaaactctccaacatttactctagcaataactagagagtttactgtccattgggtcctcttcacacctgatagaaaaaataaaattcctcaccccatggaagtcatgaaatactccctgcacagatttgtgtgagcttgcttttctaaaaccactgctcaaaaatgctgcttagtttatctataaaccacggttataccccagtgaggtaggtaagtaatttattcataactaacatttatgcagctctattttctagccactgtgctgagtgcttttatggactatctcaccaaatcccttcaacaactctattcagtaggttccattttatagatacaaaaactgaagcacagatatattatgtgacttgtccaaggtcacacagctagcaggtggaactgggatttgaacccatgcaatctgacacaagagttcatgtgtctaatcattatctgtggtttgggggacaccattacattaaaatgaatgagtcactaagtgagtcactgtatataaaatacttggaaattgtaaagtaatatacaaaagatattaacaaagtattattcatggtaaacaaatcacatcagtagcaaacacagggtgggaactcaatcttatgttatagcttactcttaagaagaatatgtgaagccaggaacatggttaaaggtacagaccagaaaatttctgacatgtgataaatatttcagtgacttttcagatttatttcttgttagccgctgtgtctatttggtgctacaaaaactgaaagaaacaaaatccctgatgtaagggcttataataaatacacagtttggagatgaactaaggatattttacatttacgggaaaggattggacaatagtatcattttctcaccatttgcatgtacatcatgtctttccaattgttttcattatttttctgaaagagctgcaaaattgtgcagtggttcaacctgaccaaagtggtattatgctgctgggaagtaaaagtattagacaccaaa

SEQ ID NO: 149350 - DNA, 546 bp, Homo sapiens
  Payload ID: 9485
  Gene Symbol: LIN7A
  Gene Name: lin-7 homolog A (C. elegans)
  ENST ID: ENST00000552093
  CDS Start-End: 1-392
tactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtggtatgtttataaaataaccagagattttctccttaagcacattctttttttttgccccctgctattactgaagtcaacgttgaaaacctagaataaatattcattttatgtctaaccagctttctaagcattgatggatattaaacctataaaagctgcaatctaa

SEQ ID NO: 149351 - DNA, 905 bp, Homo sapiens
  Payload ID: 9485
  Gene Symbol: LIN7A
  Gene Name: lin-7 homolog A (C. elegans)
  ENST ID: ENST00000549417
  CDS Start-End: 1-543
acttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgcttctaagaagtcaaaaacagatggaaactcatgtcagctcagcaatcattgggagagaaaattttttctatccctaggcaccaagagaaatttcccatgggaatgttacaaatgagacattgaaccacctaatacaattccatagaaaatacagaggcctttggtgtatggctacttcttatatcaatcctcagtgaaaccttacaactgaatgctgaattaaaatttaacattaataggaggtcaaaatgttacagtaagaatttatagctttctaatgatctccttttcacccttttatgctcaagtgttttctccgcaattttaagagagaactcaaggactatttataagggttgcagccaatgtggagccagcggcaaccgtaaatatatttagtgatagagtcaggatataaaaagtctcaatagaatggtac

SEQ ID NO: 149352 - DNA, 755 bp, Homo sapiens
  Payload ID: 9486
  Gene Symbol: LIN7B
  Gene Name: lin-7 homolog B (C. elegans)
  Uniprot ID: Q9HAP6
  ENST ID: ENST00000221459
  CDS Start-End: 45-668
gccggcgccagggcaggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctca

SEQ ID NO: 149353 - DNA, 582 bp, Homo sapiens
  Payload ID: 9486
  Gene Symbol: LIN7B
  Gene Name: lin-7 homolog B (C. elegans)
  Uniprot ID: Q9HAP6
  ENST ID: ENST00000391864
  CDS Start-End: 82-495
ggcccggggcgtggcctcgcgcagccccgccctcctcgccggcgccagggcaggcgggcggctggcagctgtggcgccgacatggctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaagagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtccttggagtctcgaggttgaaaccacagatctggacgttcacgtgcactctcttcctgtacagtatttattgttcctggcactttatttaaagatatttgaccctca

SEQ ID NO: 149354 - DNA, 795 bp, Homo sapiens
  Payload ID: 9486
  Gene Symbol: LIN7B
  Gene Name: lin-7 homolog B (C. elegans)
  ENST ID: ENST00000595200
  CDS Start-End: 1-398
ctgcgctggtggagccgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaagaaatacaaaaaaaaaaaaaaagaaagaaaaagccgagcgtggtggcgagtgcctgtaatcccagctggattacaactccggaggctgagacaggagaatcgcttgaacccaggaggccgaggttgcagtgagccgagatcatgccattgcactccagcctgggcaacagagtgagacttcatctcaaaaaaaaaaaaaaagccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtgagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagcta

SEQ ID NO: 149355 - DNA, 367 bp, Homo sapiens
  Payload ID: 9486
  Gene Symbol: LIN7B
  Gene Name: lin-7 homolog B (C. elegans)
  ENST ID: ENST00000486217
  CDS Start-End: 1-347
cgctggggctggagcgggacgtgtcccgggcggttgagctcctcgagcggctccagcgcagcggggagctgccgccgcagaagctgcaggccctccagcgagttctgcagagccgcttctgctccgctatccgagaggtgtatgagcagctttatgacacgctggacatcaccggcagcgccgagatccgagcccatgccacagccaaggtgggccccgcaccccattgctcctggtgtctatttaactgcctagtcgaactcaatatctccttcatgccagtcatttctgtttcctccctcatgatttttgctaaatctatgtgccaccttactattagtaaataatcgcacatttttaacttaaa

SEQ ID NO: 149356 - DNA, 4688 bp, Homo sapiens
  Payload ID: 9487
  Gene Symbol: LIN7C
  Gene Name: lin-7 homolog C (C. elegans)
  Uniprot ID: Q9NUP9
  ENST ID: ENST00000278193
  CDS Start-End: 22-615
gtctgtaggttaagggagaagatggcggcgctaggggaacccgtgcggctggagagagatatttgtagagcaattgaattattggaaaaactacaaaggagtggagaagtaccaccacagaaacttcaggctttgcaaagagtccttcaaagtgaattctgcaatgctgtgagagaggtatatgaacatgtctatgagactgtggacatcagtagcagtcctgaagtgagagcgaacgctactgcaaaggctactgttgctgcatttgctgccagtgaaggacattctcatcctcgagttgttgagctaccaaaaacagaagagggccttggattcaatattatgggaggcaaagaacaaaactctccaatctatatatcccgaataattccaggtggaattgctgatagacatgggggcctcaaacgtggagatcaactcctctctgttaatggagtgagtgttgaaggagaacatcatgaaaaagctgtagaactgctgaaagccgcacaaggaaaggttaaattagtggtacgatacacacccaaagtcttagaagaaatggagtcgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacatcatttatggttccagagatgcatacacttttttctgacaagaaaaagtaaaaggtgatgagggcaattctgtcctactgtttttacaggcctttttcaaatgcagattttgtcataaagttgttatagattttttaaaatgcttttttaatattaaaatgtacttttacattcttaatctttttttagaaaggaaaagttttcttcatttagctgctgatttaaaagtaaagttctccaattctttttttttgcttactctattttttttaacctgtgaaatttctttacagttttccaagaaattaagcataacagtctcatctacggcagttcattacactgtcaatgttaacatcattgctgcattttgtactttgaacacacacataatatatataaccagtggtaaatcatgactcagtacagtgcaagttttttcacttttacttaaacataatatataatggatattcatttatactgatttatgaaagtaagtttttaaacactgaaacaatcattgctaaaatacatattcttaatatttgagcattgaggcaagaggatgtaattgatagcattacttattacatccctatttatgttcaaccgtacatcaaattataaatgcaaaacaggttcagatttcatcttttgtgatttcttttaaatactattcatttttatttaaatgcacagtatttcccctatattttagtccttccattcctagagacaaaccagttatttggtggtgggaagtagctgaagcaaagaaggaaaagtaatacctttaacctcactagcttcaagagtagacattcttactagctcaatttaaataattgattttaaataggaagaaaagaggatatatttaagatacatagaaattatgatgtgaagtattcatgagaatctgtagattccatcaaaataagtaggaactcatactaaaattgttggatttaaagaggcaacttttgtttatgattcaaatatgggaatttgagaaatatttcatttgtccactggatgtcactattttactaaaaggcagctattagtgtgggactgtgactgaggtcttaaagactgaaagagttggggttcattttctgttacaacttacaggaacatttgtactttaagaaaaatttaagtgacaaatgttagaagatgatggattgaaaaatataagtaatttggcatattgaccctatataaaaaagtgggcattttgtaacattccttcaggaagaatagaattgtatgcttttttctgcatgtttgtgatcactgtgagtctcagatgattattccagttttcaatgatttttcaaaataaaagtcaatcagcattgttatttatcattaaggtattgaacactggattgcatggttgaatgtgtctttaatccactacaaaatgtgcttgttattgataggatcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcgcccgcctcggcctcccaaagtgctggaattactggcgtgagccaccatgcccagcctcaaatatgtttttaaaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagaactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagtta

SEQ ID NO: 149357 - DNA, 4290 bp, Homo sapiens
  Payload ID: 9487
  Gene Symbol: LIN7C
  Gene Name: lin-7 homolog C (C. elegans)
  ENST ID: ENST00000524596
  CDS Start-End: 18-539
gtaggttaagggagaagatggcggcgctaggggaacccgtgcggctggagagagatatttgtagagcaattgaattattggaaaaactacaaaggagtggagaagtaccaccacagaaacttcaggctttgcaaagagtccttcaaagtgaattctgcaatgctgtgagagaggctactgttgctgcatttgctgccagtgaaggacattctcatcctcgagttgttgagctaccaaaaacagaagagggccttggattcaatattatgggaggcaaagaacaaaactctccaatctatatatcccgaataattccaggtggaattgctgatagacatgggggcctcaaacgtggagatcaactcctctctgttaatggagtgagtgttgaaggagaacatcatgaaaaagctgtagaactgctgaaagccgcacaaggaaaggttaaattagtggtacgatacacacccaaagtcttagaagaaatggagtcgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacatcatttatggttccagagatgcatacacttttttctgacaagaaaaagtaaaaggtgatgagggcaattctgtcctactgtttttacaggcctttttcaaatgcagattttgtcataaagttgttatagattttttaaaatgcttttttaatattaaaatgtacttttacattcttaatctttttttagaaaggaaaagttttcttcatttagctgctgatttaaaagtaaagttctccaattctttttttttgcttactctattttttttaacctgtgaaatttctttacagttttccaagaaattaagcataacagtctcatctacggcagttcattacactgtcaatgttaacatcattgctgcattttgtactttgaacacacacataatatatataaccagtggtaaatcatgactcagtacagtgcaagttttttcacttttacttaaacataatatataatggatattcatttatactgatttatgaaagtaagtttttaaacactgaaacaatcattgctaaaatacatattcttaatatttgagcattgaggcaagaggatgtaattgatagcattacttattacatccctatttatgttcaaccgtacatcaaattataaatgcaaaacaggttcagatttcatcttttgtgatttcttttaaatactattcatttttatttaaatgcacagtatttcccctatattttagtccttccattcctagagacaaaccagttatttggtggtgggaagtagctgaagcaaagaaggaaaagtaatacctttaacctcactagcttcaagagtagacattcttactagctcaatttaaataattgattttaaataggaagaaaagaggatatatttaagatacatagaaattatgatgtgaagtattcatgagaatctgtagattccatcaaaataagtaggaactcatactaaaattgttggatttaaagaggcaacttttgtttatgattcaaatatgggaatttgagaaatatttcatttgtccactggatgtcactattttactaaaaggcagctattagtgtgggactgtgactgaggtcttaaagactgaaagagttggggttcattttctgttacaacttacaggaacatttgtactttaagaaaaatttaagtgacaaatgttagaagatgatggattgaaaaatataagtaatttggcatattgaccctatataaaaaagtgggcattttgtaacattccttcaggaagaatagaattgtatgcttttttctgcatgtttgtgatcactgtgagtctcagatgattattccagttttcaatgatttttcaaaataaaagtcaatcagcattgttatttatcattaaggtattgaacactggattgcatggttgaatgtgtctttaatccactacaaaatgtgcttgttattgataggatcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtattcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctagggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattaggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcgcccgcctcggcctcccaaagtgctggaattactggcgtgagccaccatgcccagcctcaaatatgtttttaaaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaa

SEQ ID NO: 149358 - DNA, 3567 bp, Homo sapiens
  Payload ID: 9488
  Gene Symbol: LIN9
  Gene Name: lin-9 DREAM MuvB core complex component
  Uniprot ID: Q5TKA1
  ENST ID: ENST00000328205
  CDS Start-End: 547-2223
gctgggaccgagtcccggacgtcgcgacgcgcagggggctgctgcggccggcggtctcgggaaaagtgaggggacggaggcgcccaagcaacgtgggtttcgggaactgtgagtatttcactttgcgtagagccccctcgggcaatgcgacccagaaccgagggcttctttccccccgccggggcctccctcccgttctccactcggaacaaacagcctgcagttcccgcagctgcagcgcgggccgcggaacatgcgccgggagcggggcccgggcgggactccggagctggtactgctccccccgcgctccggcgccgggcctcgccgtgcggcctccttcctcccttcctcccgcccggctcggccggaggcggcggcggaggggcgaggcgcggccccccttcggcggcacctcctccccgggcaggcgcgggcggagccgggcccgcctcagccagccgcggcgggagcagcgcagcgcggcgccgcgggcagcgagctccgcattcgaacctccctcgcaaagacagtctccgccccacaatgcaccgcggcgggcagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaaaggaacatatcaagaaattaagggaaatgaacacagaagcagaaaaattgaaatcatattccatgcccatcagcattgaatttcagcggagatatgcaacaattgttctggagcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatatttttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaacgctgcctaaaatgttaatcttgtaaaaagtatgtatttggaattttcttcgttttaatagaatattataaactcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgtaattctaaataaattgatctatgaaaatta

SEQ ID NO: 149359 - DNA, 686 bp, Homo sapiens
  Payload ID: 9488
  Gene Symbol: LIN9
  Gene Name: lin-9 DREAM MuvB core complex component
  ENST ID: ENST00000359525
  CDS Start-End: 474-686
ctgctgcttgcccagcggttgcaccggccgggacggacggccgtgccctccgctgggcaggtgggctgactgccagccccactgtggtcccctagtcctcccactccggtgttgccgccgcgtcgccgcctttgttatggtgtctgtgtgttggtttctggggttgtgtgagcgccagggccggaaaccgagagcccgggagtccagcctgtgccaggcggaggcggtggctgctcccctggcgccactccggcccccagccgaggtggagggaagagcggcccctgggcgcgggggctgtcctcgccgcctgcaccactcgcccggcgccgagagacgcccgccggggctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtata

SEQ ID NO: 149360 - DNA, 3186 bp, Homo sapiens
  Payload ID: 9488
  Gene Symbol: LIN9
  Gene Name: lin-9 DREAM MuvB core complex component
  ENST ID: ENST00000366808
  CDS Start-End: 1-1842
gaaacagctgagcagaacagttctttagctgtcggcctaaatgaccaacttcatgacctctcaaggtctcgctccccggctgcacgcagctcagcttccaacattcgggaaaggcgtgcccggatcgcgaggggccgctgggaccgagtcccggacgtcgcgacgcgcagggggctgctgcggccggcggtctcgggaaaagtgaggggacggaggcgcccaagcaacgtgggtttcgggaactgctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaaaggaacatatcaagaaattaagggaaatgaacacagaagcagaaaaattgaaatcatattccatgcccatcagcattgaatttcagcggagatatgcaacaattgttctggagcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatatttttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaacgctgcctaaaatgttaatcttgtaaaaagtatgtatttggaattttcttcgttttaatagaatattataaactcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgtaattctaaataaattgatctatgaaaatta

SEQ ID NO: 149361 - DNA, 2909 bp, Homo sapiens
  Payload ID: 9488
  Gene Symbol: LIN9
  Gene Name: lin-9 DREAM MuvB core complex component
  ENST ID: ENST00000460719
  CDS Start-End: 1-1557
cagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaaaggaacatatcaagaaattaagggaaatgaacacagaagcagaaaaattgaaatcatattccatgcccatcagcattgaatttcagcggagatatgcaacaattgttctggagcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatatttttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaacgctgcctaaaatgttaatcttgtaaaaagtatgtatttggaattttcttcgttttaatagaatattataaactcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgtaattctaaataaattgatctatgaaaattattattttc

SEQ ID NO: 149362 - DNA, 1916 bp, Homo sapiens
  Payload ID: 9488
  Gene Symbol: LIN9
  Gene Name: lin-9 DREAM MuvB core complex component
  ENST ID: ENST00000481685
  CDS Start-End: 68-1537
agcgcggcgccgcgggcagcgagctccgcattcgaacctccctcgcaaagacagtctccgccccacaatgcaccgcggcgggcagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaaaggaacatatcaagaaattaagggaaatgaacacagaagcagaaaaattgaaatcatattccatgcccatcagcattgaatttcagcggagatatgcaacaattgttctggagcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcaggtaattcgttaggtatactctaatcattttaatgtgaagttcatagtaattttcagtccaggttttaagaattatgcatatttgtgaagtactcatatattattatccgttaaatatatttgtaagagcttttcacttatatccagcctatggacagaatagaaatttcacatggattttgtatataaagaaatcaggacatatatttaggtttggggtcagcatggaggttgagcttagaggtagagcttccccagtcagtgagagactcatcttctccttccagccccccgtggctcctttgcttctttagagcatatttgttcaactactactgaagtagaattatggctaatatattagaggagatttattccttccct

SEQ ID NO: 149363 - DNA, 3849 bp, Homo sapiens
  Payload ID: 9489
  Gene Symbol: L1TD1
  Gene Name: LINE-1 type transposase domain containing 1
  Uniprot ID: Q5T7N2
  ENST ID: ENST00000498273
  CDS Start-End: 296-2893
gagatcgggaatcctctcagtccttagttacaaggctccatcctcactttgttcgctcctcagtcgtccaggcggattcctttttcgccaggcaccaaggcacagcttagagtagacccgagtcctgctctgcggagttcgtcttcccagcgaaggtacagaggcggatgaactgctgagacttgattgacgtattttaagatttttttaacttctgaagtctagcaggcctgtaagaacaaaaatcattctgtaggaattaaaaacagaatccagtcttgacaacatatccacaatgtctgatgtatctactagtgtacaatcaaaatttgctagacttgcaaagaaaaaggaaaatatcacctatatgaaaagagagcagttaacagaaactgataaggacatagctccggtattagatttaaaatgcaaggacgtatcagcaattatgaataagtttaaggtcttaatggaaattcaagacctgatgtttgaggagatgagggaaactcttaaaaatgacctaaaagcagttttagggggaaaagctacaatacctgaggtaaagaattcagagaactccagtagtaggacagagtttcagcaaataatcaatttagcattacaaaaaacagggatggtagggaaaatagaaggagaaaactctaaaataggtgatgataatgaaaatttaacctttaaattagaagtaaatgagctgagtggtaaattagacaacactaacgaatacaatagtaatgatggtaagaaattaccccagggtgaatcacgaagttacgaagtcatgggaagtatggaagaaaccttatgcaatatagatgacagagatggaaatcgcaatgtccatttagaatttacagaaagagagagtaggaaggatggagaggatgaatttgtcaaagaaatgagagaggaaagaaaatttcagaaattgaagaataaagaggaggttttaaaagcctccagagaagaaaaagtgttgatggatgaaggagcagtacttaccctggtagccgacctttcatcagcaacactggatattagtaagcaatggagtaatgtcttcaacattctgagagaaaatgattttgaacctaaatttctgtgtgaagttaaattagcatttaaatgtgatggtgaaataaagacattttcagatctgcaaagccttagaaaatttgccagccaaaaatcttctgtgaaagaattactgaaagatgtactcccacaaaaggaagaaataaatcaaggaggaagaaaatatggaattcaagaaaaaagggataaaaccctaatagactcaaagcatagagctggagaaataaccagtgatggcttgagcttcctatttcttaaagaagtaaaagttgctaagccagaggagatgaaaaacttagagactcaagaggaagagttttccgagctagaggagctggatgaagaggcctcagggatggaggatgatgaagatacctcagggctggaggaggaggaggaagagccctcagggctggaggaggaagaagaagaagaggcttcagggttggaggaggatgaggcctcagggctagaggaggaagaggaacagacttcagaacaggactcaacctttcagggtcatactttggtagatgcaaagcatgaagttgagataaccagtgatggcatggaaactactttcattgactctgtagaggattctgaatcagaggaggaagaagaaggaaagagctctgaaacaggaaaggtaaagactacctccctgactgagaaaaaagcctcacgtagacaaaaagaaattccctttagttatttggttggggactctgggaagaaaaagttggtgaaacaccaggtggtgcacaaaacccaggaggaagaggaaacagctgtgcccacaagtcaaggaactggcacaccctgtctgaccttatgtttggcctctccctcaaagtcactagagatgagtcatgatgagcataaaaagcattcacatacaaatttgagtatttcaacaggagtcaccaaacttaagaaaacagaagaaaagaaacacagaactctgcacacagaagaactaacatccaaagaagcagacttaacagaggaaacagaagaaaacttgagaagtagtgtgattaatagcatcagagagataaaagaggagattggaaatttgaaaagttcccattcaggtgtcttggaaattgaaaattcagtagatgatctgagtagcagaatggacatacttgaagaaagaatagacagtctagaagatcaaattgaagaattctctaaggatacaatgcaaatgaccaaacagataattagtaaagaaaggcaaagagatatagaggagagatctagaagttgcaacattcgtttgataggaattccagaaaaggagagttatgagaatagggcagaggacataattaaagaaataattgatgaaaactttgcagaactaaagaaaggttcaagtcttgagattgtcagtgcttgtcgagtacctagtaaaattgatgaaaagagactgactcctagacacatcttggtgaaattttggaattctagtgataaagagaaaataataagggcttctagagagagaagagaaattacctaccaaggaacaagaatcaggttgacagcagacttatcactggacacactggatgctagaagtaaatggagcaatgtcttcaaagttctgctggaaaaaggctttaatcctagaatcctatatccagccaaaatggcatttgattttaggggtaaaacaaaggtatttcttagtattgaagaatttagagattatgttttgcatatgcccaccttgagagaattactggggaataatataccttagcacgccagggtgactacaaacaatatgctttcctcccccagcatgcatccaaaaatcaacaagtaaaacgaaaatacacttctacccagaaggatggacagctaatagcgtacttggggatgaggagcaaggaatattacagatattacctagatgttaataaagggtatgtttaaaaaaaataggctggtctcaatgtagtgagttatttcagttgatcacagtcagttacagatagaattccttgttttacttcccccccaccacctccctactgcagttgactagtctttttagaatttatattatctggctgggcacggtggctcacacctgtaatcccagcactttgggaggccgaggcgggtggatcacgaggtcaggagatcgagaccatcctggctaacacagtgaaaccccgtctctactaaaaataaaaaaaattagccgggcatggtggcgggcgcctgtagtcccagctacttgggaggctgaggcaggagaatggcgtgaacccaggaggcggagcttgcagtgagccgagatcacaccactgcactccagccggagccacagagcgacactccgtctcaaaaaaaagtatattgtgctagcttgtctaagaataaacttctatactgttgggggagggctgcacctgtcaagataacctgtcaatgtagtaggaaaacaggaggggacagtaacagaaaagcacgggaaaagatggcaaggttagttaaaatagaaaagtgctcagttcctcatacctgtaatcccagcagtttagggggccaaggcaggtgggtcacttgagcccaagagttcaaggccatcctgggcaatgtggcgaaagtgtctacaaaaaaatacaaaaagaggaagaaatgatatttcacaagtttgtatcatttgtcatgatgtgactcgaatatattaaatctttttcctttgaa

SEQ ID NO: 149364 - DNA, 4821 bp, Homo sapiens
  Payload ID: 9490
  Gene Symbol: LINS1
  Gene Name: lines homolog 1
  Uniprot ID: Q8NG48
  ENST ID: ENST00000314742
  CDS Start-End: 224-2497
ctctgcgcatgcgggaggaggtgccagcttgtactttctgtgaactacggtggcccagagcgggcatttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaagtgaaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccagaggatgtgaagccactgaaagcttgactcagggaaaagaaatgtgggaccatcacacacatgaaaatggctataatcctcactgtattttcttgttcttcttgaaaaatataggatttgattccacagttcttcttgactttttgatttcatcagaaacctgttttcttgaatattttgttagatatttaaaattactgcaaaaggactgggataattttttcaccatttgcaataactttgatgcaactgaatctaaatatgacataagtatttgtggctgtgtcccctcacttgtccaagaccaaagctccaaccaaacaataccccatcgtttgactgctcctcatagtcacagagatgtgtgtgctcggcactcctgggcttccgatgctccctctgaaccactgaaagctgtgatgtccaagggggctcacaccatgtgtgcttctagtctgtcttccccccgggcctctcaaagtctggtagattacgacagctctgacgattctgacgtggaatccacagagcagtgtttagctaacagtaaacagacatctttacaccagcaagcaactaaggagattcaggatgcagctgggacaagcagggataaaaaagaatttagccttgagcctccatcaaggcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgtaaaacattgacattttattttccaggtattgtttttccttaatataaattatgtctcaatgaggtaatagtataaaatcatcaccataaaagggttttcttttttttttttttttttgagacagaatctcattctgtcgctcaggccggagtgcagtggcgtgactcgactcactgcaacctccacctcctgggttcaagcaattctcctgcctcagtctcccgagtagctggaattacaggtgcccgccaccacgcccagctaatttttgtatttttagtagagacgggggtttcaccatgttgccaggctggtctcaaactcctgacctcaagtgatccgcctgtccgccctcccgaagtgctgggattacaggcatgagccactgtgcccggctgggttttctagacaagttcttactttttgccttattggaagcaacctagtgactgaaaaagagacatcaagtgacaagtcactcattatagctatataccactggagatttatggcagttctaagtgacacaaaatcgggggtggtgattgcgttcctcagctagggctgccgtaacaacttgccacgtgtgccgcagcttcagacacctggaattatcctcatagttttggaggccagaatccaaactcaggcttcagcagggcaatgccctcagggtctggagaagaatcccaccctgcccctttctggcttctggtggcagccagccagccatggtgtcccttgtcttgtagtggcgtcactccagttcctgcctcacatggcattttcctgtgtctgtgtccagtttccctcctacaaggacatcggtcattggactaggacctaccctcatccagtatgatctcaacttgatgacagctgcaaagaccctaatcccagatatggccactttcatgtgtccttgatggacttgaatccaggagagtcactaaccaaatacagttactatttccttctggggtatttacacagaaagcgatatattacaaatgtaaaatcttagccgtttctttgagaagtgattatacctggcctactgtatgaacatgattctttctaaaaaaaaatttaatcactaattttcctatttaaaattgtgacatgaataattatgttccatattcttgaggggaagccgtaaattccattgtaatatgtttgtgtaataggagcaatagctatattgtgctgcgaagtctggcattaaggcagtctaaaatattgcctgtacatttttttttaatgatctctttgcagagaaacagaacaaagactaaacctaccgcacattaaaatatatattaaggctatggtattcgaaacagtttagtacttaattcaggtagacatggaaaaatcagtggagctaaatagaaggttgccgattaaaataacagcgaagtaccagtgttagccaaatagcaatgcaaaggtcaaaaggtttgcgttttaacatgctgtcggtgaggctatgcgttaaggcagtttctaccgtaattgaaaaagcacgtcaaagaatgtgtattcaaggatgccacatagtttgtaaaaaatgttaaggttttagagttttactagaaatacctggtaaagtaagtcagaatttgtatagtcagtggaatggtagatgcgttctatgcacgtttgtggatgtgaaacatctccagtaaaaaacaagtaaatacatggggcttgcaattatttagggaaagaagcagggcgggagtaatacacattcatatatatgcttttgtgcatgtataaaatatgtatgtaagactacataagaaagtcataatagtggttgccttgggagacaggtctgatgtggaagacaaagtctcatctttttgtactatttttagtgggatacatgcagcactgcattaggatgtttcaataacagaccacatagtacagtggtcccataagactatcaagccgttatttttactgtgactgtcctatgtttaggcatgtttagatacacgcatacttactattgtgttacagttgcctacagtattcagtacagtaacatgctgtgtacaggtttgtagcctaggagcaatgggctataccatatagcctaggtgtgtagtaggctatgccatctaggtttgttgagtatactctgtgacatacatgacatgacaacaaaattgccttacagctcatttctcagaacatgtccctgtcatgtgacacatggctgttttttgatggaaataactgggaaaaaaaaatcgactcttgttcctaagggtacataaatgttgaatgcattataactcatgcttatgca

SEQ ID NO: 149365 - DNA, 872 bp, Homo sapiens
  Payload ID: 9490
  Gene Symbol: LINS1
  Gene Name: lines homolog 1
  ENST ID: ENST00000559736
  CDS Start-End: 277-872
agagcgggcatttgtgttccctcaaatggcggtgtgaagagagttcgcctgagccagatcccagttttaacaagggaggcatgagacatcaatcaagatatgtaaaatgaacattggttcagtccagaaaggtgggacaactcttaagctgggagggggcttccaggtcacaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaa

SEQ ID NO: 149366 - DNA, 558 bp, Homo sapiens
  Payload ID: 9490
  Gene Symbol: LINS1
  Gene Name: lines homolog 1
  ENST ID: ENST00000560272
  CDS Start-End: 172-558
agagcgggcatttgtgttccctcaaatggcggtgtgaagagagttcgcctgagccagatcccaggcaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtc

SEQ ID NO: 149367 - DNA, 827 bp, Homo sapiens
  Payload ID: 9490
  Gene Symbol: LINS1
  Gene Name: lines homolog 1
  ENST ID: ENST00000559577
  CDS Start-End: 254-827
ggcggtgtgaagagagttcgcctgagccagatcccaggcagttttaacaagggaggcatgagacatcaatcaagatatgtaaaatgaacattggttcagtccagaaaggtgggacaactcttaagctgggagggggcttccaggtcacaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctct

SEQ ID NO: 149368 - DNA, 562 bp, Homo sapiens
  Payload ID: 9490
  Gene Symbol: LINS1
  Gene Name: lines homolog 1
  ENST ID: ENST00000560934
  CDS Start-End: 131-562
gttaatctggaactgccatagcttcaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgtta

SEQ ID NO: 149369 - DNA, 1612 bp, Homo sapiens
  Payload ID: 9490
  Gene Symbol: LINS1
  Gene Name: lines homolog 1
  Uniprot ID: Q8NG48
  ENST ID: ENST00000561308
  CDS Start-End: 155-1465
gtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacatcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaagtgaaaggtaattctccaaactccttttgtatgcagtgtgtaattatttacttaagtacagtaattcataattatcaaatctcaggactagtttaaattccagtaatttaagctgtatgttatcctatttgtaacttattacattttcaaaaaaaaaaaaaagaactggatttacctttaagaaacatgtcagctttttgtgcctacaatgaatttgtaaagcataaggaatgatttaggttt

SEQ ID NO: 149370 - DNA, 1196 bp, Homo sapiens
  Payload ID: 9490
  Gene Symbol: LINS1
  Gene Name: lines homolog 1
  ENST ID: ENST00000560133
  CDS Start-End: 158-1111
tttgtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaagatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaaagcagttcctgactcatttcgacaccatttttgaagtgttttacaattccttattctctcagcattttgaaaactgccgggatacttctaaaatagtaaacatcctgatgtgtttcctggatttgcttgagcttctcatcgcctccagaatccacctgaagttacatttcacttgccagaggattttatttttgaaaccatcttgcatgctagaagttattacctggcctattcaggcttttgttaaaaggaaggtcatcatattcctcaaaaagtgccttctctgtaaagtgggtgaagacctctgtcgtggatctgtgcctgccttaatgccgccagaccatcatgtagcggtggacatgctggctttagctaatgctgttttgcaagctgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaagtgaaaggtaattctccaaactccttttgtatgcagtgtgtaattatttacttaagtacagtaattcataattatcaaatctcaggactagtttaaattccagtaatttaagctgtatgttatcctatttgtaacttattacattttcaaaaaaaaaaaaaagaactggatttacctttaa

SEQ ID NO: 149371 - DNA, 588 bp, Homo sapiens
  Payload ID: 9490
  Gene Symbol: LINS1
  Gene Name: lines homolog 1
  ENST ID: ENST00000560941
  CDS Start-End: 192-588
tttgtgttccctcaaatggcggtgtgaagagagttcgcctgagccagatcccagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgatcaaagtgatgacaacccggatattgtctgtcaaaaccgagttccatgcaaaggagcagtacagagatgtaattaaaattctcttagaatcagccaaagtcgattctaaattaatctgcatgttccaaaattcagataaattgttatctcacatggctgcacagtgccttgcattgcttctatatttccaattgagagaaaagataaccttaagtaattcctggattgctttttgccagaaaaatctttctgaatactctgagagtaataaagcaatatactgcctctggactcttacagcaataataaaagaaatctttaaagattcatgttcacagaaaacagaaattctaa

SEQ ID NO: 149372 - DNA, 511 bp, Homo sapiens
  Payload ID: 9490
  Gene Symbol: LINS1
  Gene Name: lines homolog 1
  ENST ID: ENST00000560783
  CDS Start-End: 1-208
tgtgaattcggggttgttgaagacactgtctgtttatgaaaaacattccttttttggaggtgatgaagttcaacctgaatgtgaacttatcactagtccagatcatgtgatccttagagcagcaagcttagttataatgaaatccttagaaatcaagtttcaaaattattcttcagcaagtgaagtgaaagacatggagattaagtagcttgcccaagatcacccagccagtaaagtggcagagctgaagtaatggattcagacacccactaacaacaagaaagaggccaaatcacaagcaacaagacacatgcggacaaaatggaaaaggagaaaacaattttggaagctcaaagtctgctgtggaggatggccaaggcctgcctctagtgaagatgtgtcattccagttgttataggccaatggtgacatacccaatgtgggaggctggattcacaaacacagcagcatgccatttggaatagtgatatgtagaacagacgatgctggg

SEQ ID NO: 149373 - DNA, 1459 bp, Homo sapiens
  Payload ID: 9491
  Gene Symbol: LAT
  Gene Name: linker for activation of T cells
  Uniprot ID: O43561
  ENST ID: ENST00000360872
  CDS Start-End: 79-867
accccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaac

SEQ ID NO: 149374 - DNA, 1616 bp, Homo sapiens
  Payload ID: 9491
  Gene Symbol: LAT
  Gene Name: linker for activation of T cells
  Uniprot ID: O43561
  ENST ID: ENST00000395456
  CDS Start-End: 323-1024
cgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaac

SEQ ID NO: 149375 - DNA, 1448 bp, Homo sapiens
  Payload ID: 9491
  Gene Symbol: LAT
  Gene Name: linker for activation of T cells
  Uniprot ID: O43561
  ENST ID: ENST00000395461
  CDS Start-End: 37-846
gggcctccctgctcgctgcctccccgggtcctggatatggaggccacggctgccagctggcaggtggctgtccccgtcttggggggggccagcagacccttggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaatt

SEQ ID NO: 149376 - DNA, 1262 bp, Homo sapiens
  Payload ID: 9491
  Gene Symbol: LAT
  Gene Name: linker for activation of T cells
  Uniprot ID: O43561
  ENST ID: ENST00000454369
  CDS Start-End: 296-994
tgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctg

SEQ ID NO: 149377 - DNA, 816 bp, Homo sapiens
  Payload ID: 9491
  Gene Symbol: LAT
  Gene Name: linker for activation of T cells
  ENST ID: ENST00000562701
  CDS Start-End: 1-258
atggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccgcatgacccctgacctttgactcccagaagatccccgcagccccttgggggctcccaccggacgccatcttcccggcgggattctgatggtgccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactga

SEQ ID NO: 149378 - DNA, 707 bp, Homo sapiens
  Payload ID: 9491
  Gene Symbol: LAT
  Gene Name: linker for activation of T cells
  ENST ID: ENST00000570232
  CDS Start-End: 1-501
atcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctg

SEQ ID NO: 149379 - DNA, 786 bp, Homo sapiens
  Payload ID: 9491
  Gene Symbol: LAT
  Gene Name: linker for activation of T cells
  Uniprot ID: O43561
  ENST ID: ENST00000566177
  CDS Start-End: 1-786
atggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccatccccgcagccccttgggggctcccaccggacgccatcttcccggcgggattctgatggtgccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactga

SEQ ID NO: 149380 - DNA, 921 bp, Homo sapiens
  Payload ID: 9491
  Gene Symbol: LAT
  Gene Name: linker for activation of T cells
  Uniprot ID: O43561
  ENST ID: ENST00000564277
  CDS Start-End: 216-914
agcttcctgccgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctg

SEQ ID NO: 149381 - DNA, 610 bp, Homo sapiens
  Payload ID: 9491
  Gene Symbol: LAT
  Gene Name: linker for activation of T cells
  ENST ID: ENST00000630764
  CDS Start-End: 353-610
caggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccgcatgacccctga

SEQ ID NO: 149382 - DNA, 1869 bp, Homo sapiens
  Payload ID: 9492
  Gene Symbol: LAT2
  Gene Name: linker for activation of T cells family, member 2
  Uniprot ID: Q9GZY6
  ENST ID: ENST00000275635
  CDS Start-End: 232-963
agtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccaggcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 149383 - DNA, 2363 bp, Homo sapiens
  Payload ID: 9492
  Gene Symbol: LAT2
  Gene Name: linker for activation of T cells family, member 2
  Uniprot ID: Q9GZY6
  ENST ID: ENST00000344995
  CDS Start-End: 723-1454
attatcttgctccctgtctattggagtgtatctctcttcctctctgtgtgactttttgtgtttatgtgtgtgtttagtgtgtgtccatattttcctgttctcttgtgtctctctgctgtgtctctctctttttctttctgttttttgagacggagtctccctctgtcacccaggctggagtgcagtggtgcgatctcggctcactgcaacctctgcttctgaggttcaaacgattctcctgcctcagcctcccgagtagctggaattacagacacatgccaccatgcccagctaattttgtatttttaatagagacggggtttcaccatgttggccaggctggtcttaaactcttgaccttacgtgatccacccgcctcggcctcccaaagtttttggattacaggtgtgagccacctcgcccggtcctatctctctttcttctctttctccctctcactttgtttctcttctctctctctctcccgcctccttcccccgtctcccctcccttccccccaccgccctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaagca

SEQ ID NO: 149384 - DNA, 581 bp, Homo sapiens
  Payload ID: 9492
  Gene Symbol: LAT2
  Gene Name: linker for activation of T cells family, member 2
  ENST ID: ENST00000361082
  CDS Start-End: 391-581
agtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacggtgggtggtgtgcgtatgttttgctgaggcctggtcatcacgctgtggctccaaggctgggaccagccacagaccgagaagccggtcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggc

SEQ ID NO: 149385 - DNA, 2453 bp, Homo sapiens
  Payload ID: 9492
  Gene Symbol: LAT2
  Gene Name: linker for activation of T cells family, member 2
  Uniprot ID: Q9GZY6
  ENST ID: ENST00000398475
  CDS Start-End: 138-869
aggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggggcgtcaggcagggaattctggtgacttcaggggcaaagaagtgggcaccgggtgggtctcccaactccactgcatcctcctggctgcgaccttggaccaagtgacaacctcccagaacttagttcctcacttggtgcccacctctcagagaagacatcgcacacacggccgggcacggtggctcacgcctgtaatcccggcactttgggaggccgaggcaggcagatcacctgaggtcacgagttcgagaccagcctggccaacatggtgaaacttcatctctactaaaaacacaaaaaattagccaggcatggtggtgggtgcctgtagtcccagttagttgggaggctgaggcaggagaatcatttgaaccctgaaggcggaggttgcggtgagttaagatcacatgcactcaaccctgggtgacagagcgagactccgtctcaataaataaataaaaaaacagacattgcacacaaagcctcagcccagcaggcactcggtcaatgctggaaacagacaggaggcagggacgttgggaaatgtaacagtggctgagacgcgctgaggagccaccgcaggccagtgagatggtgcggcgctaagcgctcacacgtgcaccatctcttagcacccaaagccacagagcagttaagccacctgcccaaggccacatcttgaagtaaggggaggaggagatggaatccccagtggtcagacatcagacatcaaagcctaggctgggtctactgcttgggaagcacgatggacccccagagggccttgaaggctgcccaaagtccccatctgggagacccaggccgtcatctcagcgagcaggctggagggtggaaaccacagtgaacctgggtggtcaagagtcagccccagaggcaggtgcaggagtttgagccaaatgtgcagagccccacgtcattcattcaaccagtatccactgggcccctgctacgggcaagtcctgctctaggtgctgggaacaccaacataaagaacagcaaacccctgaccccttagaacttgcattctggtaggagagagaaaacagatagggctggacacagcggtcatgcctataaatcccagcacttcgggaggctgaggcgggaggatcctttgagcctctgagtttgaggccagcctgggcaacatagcaagacctctctctctacaaaaactttttttttttttttttgagacagagtatcactgtcactcaggctggagtgcagtggcgccatctcggctcactgcaacctccacctcctgggttcaagcgattctcgtgcctcagccttccaagtagctgggattacaggcacacgccaccatgtccagcctctataaaaacatttaaaattagccaggcatggtggtggatgccctagagtcccactgacttgggaggctgaggtgggaagatcacttgagcctgggaggtcaaggttgcaatgagccatggttgctgcagtgagctgtggtcgtgccactgcactcaagcctgggcaacagagcaagaccccatctcaaaaaaaaaatttaaaaa

SEQ ID NO: 149386 - DNA, 561 bp, Homo sapiens
  Payload ID: 9492
  Gene Symbol: LAT2
  Gene Name: linker for activation of T cells family, member 2
  ENST ID: ENST00000475494
  CDS Start-End: 261-561
ggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggccatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaag

SEQ ID NO: 149387 - DNA, 586 bp, Homo sapiens
  Payload ID: 9492
  Gene Symbol: LAT2
  Gene Name: linker for activation of T cells family, member 2
  ENST ID: ENST00000470709
  CDS Start-End: 285-586
catcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacat

SEQ ID NO: 149388 - DNA, 2527 bp, Homo sapiens
  Payload ID: 9492
  Gene Symbol: LAT2
  Gene Name: linker for activation of T cells family, member 2
  Uniprot ID: Q9GZY6
  ENST ID: ENST00000460943
  CDS Start-End: 890-1621
ggagtgtatctctcttcctctctgtgtgactttttgtgtttatgtgtgtgtttagtgtgtgtccatattttcctgttctcttgtgtctctctgctgtgtctctctctttttctttctgttttttgagacggagtctccctctgtcacccaggctggagtgcagtggtgcgatctcggctcactgcaacctctgcttctgaggttcaaacgattctcctgcctcagcctcccgagtagctggaattacagacacatgccaccatgcccagctaattttgtatttttaatagagacggggtttcaccatgttggccaggctggtcttaaactcttgaccttacgtgatccacccgcctcggcctcccaaagtttttggattacaggtgtgagccacctcgcccggtcctatctctctttcttctctttctccctctcactttgtttctcttctctctctctctcccgcctccttcccccgtctcccctcccttccccccaccgccctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 149389 - DNA, 585 bp, Homo sapiens
  Payload ID: 9492
  Gene Symbol: LAT2
  Gene Name: linker for activation of T cells family, member 2
  ENST ID: ENST00000465116
  CDS Start-End: 411-585
atatcctgttctttccttcaccgtgggagacgagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctact

SEQ ID NO: 149390 - DNA, 1694 bp, Homo sapiens
  Payload ID: 9492
  Gene Symbol: LAT2
  Gene Name: linker for activation of T cells family, member 2
  Uniprot ID: Q9GZY6
  ENST ID: ENST00000488266
  CDS Start-End: 113-448
agtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 149391 - DNA, 753 bp, Homo sapiens
  Payload ID: 9493
  Gene Symbol: LIPA
  Gene Name: lipase A, lysosomal acid, cholesterol esterase
  ENST ID: ENST00000282673
  CDS Start-End: 96-753
agctcctgattctgcagaaaacacgaaactgagctgtacaaagatgctgatgaggggctgcagcatgcaattcacttcaccagcagtcactaagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattac

SEQ ID NO: 149392 - DNA, 2782 bp, Homo sapiens
  Payload ID: 9493
  Gene Symbol: LIPA
  Gene Name: lipase A, lysosomal acid, cholesterol esterase
  Uniprot ID: P38571
  ENST ID: ENST00000336233
  CDS Start-End: 324-1523
gcgtaggcgacgcgctggtagagctgtggacctgccagcctgcgaggcggaggacgggctccatctcttagaaacgcctacggcgcatgctctatggggtcaactggggggctggcaagcggcagcgctggtctggggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaagaa

SEQ ID NO: 149393 - DNA, 2513 bp, Homo sapiens
  Payload ID: 9493
  Gene Symbol: LIPA
  Gene Name: lipase A, lysosomal acid, cholesterol esterase
  Uniprot ID: P38571
  ENST ID: ENST00000371837
  CDS Start-End: 223-1254
aaatcgaaactaaacgtaagcttcagaaaccgaaacttaatagaagagctcaagagccgcggccagacgtttgcggagtccagggtctttcggagttgaatttgcagctgggctccttcactttggtctcggcttttatctgcctccctgataggtttttggtcttggtgacttcaagaatgaagctgcggactctcgctgtgagtgctacagttgttaaagatggcgtgtctggagtttgttcctttcgatgttcagatgtgtctggagtttcttccttctggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaagaa

SEQ ID NO: 149394 - DNA, 1055 bp, Homo sapiens
  Payload ID: 9493
  Gene Symbol: LIPA
  Gene Name: lipase A, lysosomal acid, cholesterol esterase
  ENST ID: ENST00000428800
  CDS Start-End: 184-1055
taaaatttaaaaattccttattctcctttcagatatggctggagtcatttgtttcatattttcctttcaccttttacttgccctaaatctggttcagaactttttgtgggagcattaagttaccagaatatttttgtgtagtaaaattcaagcaaataataatagactgttttattatacagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgca

SEQ ID NO: 149395 - DNA, 2527 bp, Homo sapiens
  Payload ID: 9493
  Gene Symbol: LIPA
  Gene Name: lipase A, lysosomal acid, cholesterol esterase
  ENST ID: ENST00000456827
  CDS Start-End: 423-1274
agagctgtggacctgccagcctgcgaggcggaggacgggctccatctcttagaaacgcctacggcgcatgctctatggggtcaactggggggctggcaagcggcagcgctggtctggggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggccc

SEQ ID NO: 149396 - DNA, 2621 bp, Homo sapiens
  Payload ID: 9494
  Gene Symbol: LMF1
  Gene Name: lipase maturation factor 1
  Uniprot ID: Q96S06
  ENST ID: ENST00000262301
  CDS Start-End: 20-1723
gagtgcgccctccccgcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcgaaaa

SEQ ID NO: 149397 - DNA, 2103 bp, Homo sapiens
  Payload ID: 9494
  Gene Symbol: LMF1
  Gene Name: lipase maturation factor 1
  Uniprot ID: Q96S06
  ENST ID: ENST00000543238
  CDS Start-End: 222-1214
aatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtactggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagctt

SEQ ID NO: 149398 - DNA, 2731 bp, Homo sapiens
  Payload ID: 9494
  Gene Symbol: LMF1
  Gene Name: lipase maturation factor 1
  ENST ID: ENST00000545827
  CDS Start-End: 309-596
ctctctctctctctcacacacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagtcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcgcggctcagcacgtcactttggactgtcgcgcagaaattcagaagactcgtagtagcttcggcagtgctctccctgccttccgagcagccatgcgtctttgaactgtcttcccttccctgatcttggagaacatagagctgccagttactgaggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcg

SEQ ID NO: 149399 - DNA, 882 bp, Homo sapiens
  Payload ID: 9494
  Gene Symbol: LMF1
  Gene Name: lipase maturation factor 1
  ENST ID: ENST00000570014
  CDS Start-End: 288-882
acacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagtcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacc

SEQ ID NO: 149400 - DNA, 694 bp, Homo sapiens
  Payload ID: 9494
  Gene Symbol: LMF1
  Gene Name: lipase maturation factor 1
  ENST ID: ENST00000566627
  CDS Start-End: 244-694
aaagatcctctccagaaacttggaccaaagtcaggacacctcaggggtcctccttcctgtggcgggagctgcccttggagcttccttcctgggcaggacggatggtggctccacttcaaagagtactgagagcagcgccagggctggaggggacgctgggaggccgccagcacccagggacaccgccctcggtgcttcatttctcactgacgatgaacagcatgtttgggctccaggacttcaatgtactctttcggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgc

SEQ ID NO: 149401 - DNA, 551 bp, Homo sapiens
  Payload ID: 9494
  Gene Symbol: LMF1
  Gene Name: lipase maturation factor 1
  ENST ID: ENST00000562380
  CDS Start-End: 1-405
atttatcggccatgcctgctgttggctgctcgggcgacacggtatttcctcggtatttcctcgttgcagctcccagtcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggtaagtgagatgcatttagagaaagctctgcgagagttgagcgttgtgtgtttggatgggagtcccagcttctggagacggggttcctggggatcttcctgtgccctctgtggacgctgtcaaggctgccccagcatacccccacatcccggat

SEQ ID NO: 149402 - DNA, 1088 bp, Homo sapiens
  Payload ID: 9494
  Gene Symbol: LMF1
  Gene Name: lipase maturation factor 1
  ENST ID: ENST00000562226
  CDS Start-End: 3-557
acatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcgcctctgccatcagccttcccagtatgcacggagggcagtgatgggcgcttgtgatctgatccgtgcctcctccctggatgtgggagctcctgggcttccaggccccgggcacctagagacggatggtcgcacgcatgattgtcggcatctcacagcggctcagcacgtcactttggactgtcgcgcagaaattcagaagactcgtagtagcttcggcagtgctctccctgccttccgagcagccatgcgtctttgaactgtcttcccttccctgatcttggagaacatagagctgccagttactgaggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctg

SEQ ID NO: 149403 - DNA, 1181 bp, Homo sapiens
  Payload ID: 9494
  Gene Symbol: LMF1
  Gene Name: lipase maturation factor 1
  ENST ID: ENST00000565276
  CDS Start-End: 1-450
ccttcgcgggcaggcccccgcccaggcgcctcagggaccctcctccacccagagggtctctgtcttcccggttttcctggcgtaattcagacttggggagagaagaatcatcatccatcacacacccagacccaaagagactcaaagccaggaggagccgggtggacccagaggccctcaccctgccagcctaaggggcatggcccaaggtctccacccccagcccccagagcacagctgtgtgcaggtcaccagaagccccaaataatgacagcagcccagacagtcgctaccgggccctggtgcagtgtgaagcctctggcacctgcctgggctcattccaggggccatgagagggtcctgttatggctgcaccatcacacccaccgggcagctggggcccagctctgccatggatcccagccaggcagcagccgccctgtgggctgagaagcttccgctcctgctgcacaactgcgaaggggcctggagggccgggagcttgtgacggtgacaattcctcctggcgcctcctcctccggggcagccgagcaaccctggacatgagggggcttcgtcccacccccaggagaaaatgcccagtcctccgagagtccagtgagggcttgccagccagggaccaagacccagtatggcctaaaccaggcctggtcaccaggggtcaggcgggaccttatacagggctcagcagagagacctgcccgctaccctgctccaggggagatgggggtgggggccttcatcccactcgggcatgacagaggagagcagccagccagcatctgcacgtctcaggcagggaagggcctgaagccctgggaagcagaggctccgccctcaggaaacaggtcccggcctggctccctcacagcctcggactgccccgtggaccgaaacccccaggcaccttgcgccaggactggcctgatggtggagacgccacaccatgagcagtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagc

SEQ ID NO: 149404 - DNA, 853 bp, Homo sapiens
  Payload ID: 9494
  Gene Symbol: LMF1
  Gene Name: lipase maturation factor 1
  ENST ID: ENST00000568964
  CDS Start-End: 1-505
aacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcggtaagtgagatgcatttagagaaagctctgcgagagttgagcgttgtgtgtttggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgaggagaagtttgcaggctgtttcctgaggtctgggccagcagcaccgccatgccctgacccaccattcccctggccgcgggctgagtgt

SEQ ID NO: 149405 - DNA, 663 bp, Homo sapiens
  Payload ID: 9494
  Gene Symbol: LMF1
  Gene Name: lipase maturation factor 1
  ENST ID: ENST00000567595
  CDS Start-End: 1-485
atccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtactctttcgcctctgccatcagccttcccagtatgcacggagggcagtgatgggcgcttgtgatctgatccgtgcctcctccctggatgtgggagctcctgggcttccaggccccgggcacctagagacggatggtcgcacgcatgattgtcggcatctcacaggatgggagtcccagcttctggagacggggttcctggggatcttcctgtgccctctgtggacgct

SEQ ID NO: 149406 - DNA, 1603 bp, Homo sapiens
  Payload ID: 9494
  Gene Symbol: LMF1
  Gene Name: lipase maturation factor 1
  ENST ID: ENST00000568897
  CDS Start-End: 531-1583
ggctctccggcccatctccacacgggcaccttctggctgacccggatcgtgctcctgaaggccctagccttcgtgtacttcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtgagatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcaggcctgatcaagatccggggggaccggtgctggcgagacctcacctgcatggacttccactatgagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccagacctacgagcacaacgactggatcatccacctggctggcaagctcctggccagcgacgccgaggccttgtccctgctggcacacaaccccttcgcgggcaggcccccgcccaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaagg

SEQ ID NO: 149407 - DNA, 2658 bp, Homo sapiens
  Payload ID: 9495
  Gene Symbol: LMF2
  Gene Name: lipase maturation factor 2
  Uniprot ID: Q9BU23
  ENST ID: ENST00000216080
  CDS Start-End: 170-2218
gtagcggacatggcgggctcccggctcccgcggcagctcttcctccagggcgtggcggccgtcttcatgtttgctttcgcttccctctacacgcaaatcccaggctgggggatctgcaggccctgactcagaggtagtctagtctgcaagggctgtccagggcctggccatgacatgccctcccacaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgctggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaagccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttg

SEQ ID NO: 149408 - DNA, 2582 bp, Homo sapiens
  Payload ID: 9495
  Gene Symbol: LMF2
  Gene Name: lipase maturation factor 2
  Uniprot ID: Q9BU23
  ENST ID: ENST00000474879
  CDS Start-End: 17-2140
gggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgctggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaagccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 149409 - DNA, 10441 bp, Homo sapiens
  Payload ID: 9496
  Gene Symbol: LIPG
  Gene Name: lipase, endothelial
  Uniprot ID: Q9Y5X9
  ENST ID: ENST00000261292
  CDS Start-End: 279-1781
aaaaactacctctataggagcgtgacagcagcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttcttaatggtctgacaactcaattttttttttttttttttttttttttgagacagagcctctctctgtcacccaggctggagtgcagtggcaatcttggctcactacaacctctgcctcctgggctcaggtggtcctcccacctcagccttctgagtagctgggattacagagatgcgtcaccatgtctggctaatttttgtatttttagtagagatggggtttcgccatgttggccaggctggtcaggctgggttcgaactcctggcctcaagtgatccgcctgcctcagcctctgaaagttctgagattataggtgtgagccaccgtgcctggccaattcttaaagtttgaaagaatatagctgccccaacctagagtctgacaaaaagttactctaatataaggcatattctttatttgacactcatcgttagcagaagtggacagcaattcactaaagaaccagaacaagaacatcatttcactgaagacgagaagaaaaattatttcaattgtagcagcttgaaggcctgaaggtggatgttaggaagaacagggagcatggctggacactggggagcattagtgagattattaggtttggttgaattggaactagatatcagtgacttagaccagagggaagctgatttctctattggttaaagtcccagctggtagtaaggttctattctacaggccaagagggctgcaggttcttagtttttcactgtgccattcatggggtattcctcgcatccccacagcccaggggtcccctaccagccaatggaaagccagaaaagggaagggatgaacagtctcctcttaaagacatgactgagaagttgcttacattctattggccagaaataaatccatggtcacatgacaggctgggaaatacagtctttatttagggtgcccatgggccctgctgaagatccaattactatttatttaaaattgacatataataattgtacatatttgtggggaaaatagtgatgtttcgatacatacaaggtatagtgatcatgttggaataattagcatacccatcctttcaaacatgtatcatttctttgtgttgggaacattcaatatcctccttctagttacttgaaaccatattttattaactctagttttacccttcagtggtataggacactagaatttattcctcctgtctagctgtaatcttgtttgtttcgtttggtgttttttgtttttttgtttttttttgagatggagtcttgctctgtagcccaggctggagtgcaggggcatgatcttggcccactgcaacctccgcctcctgggttcaagtgattctcctgcctcagcctcccaagtagctgggattacaggcatgcaccaccacacccagctaatttttgtatttttagtagagacaaggtttcaccatgttggccaggctggtcttgaactcctgacctcaagtgatccacctacctcagccttccaaactgtcgggattaccggtgtgagccaccgggcccagccactagctgtaattttgtatcttttaacaattccgtccctatttcccctttccccctaccaattactatttattaaaagggaaattggatcttgccatccgtttatcaggaattagttttttctctgctaaagccagcgagatagaccagagtaccctttaaatgattaaatcctgtagtcaatttttagtaatcttaaattgatctatgactatgaagtataatgcattacatcagtttgactttatttctggtcttaagtgtgaaaacatttctaaatgacaaggaagctctttataaagggctttagtgatggtggaaactccactgtccatctctaccaggacattctgaaaccaggcttgataatggctgtagggagttgggttagacaataagagataagttcttaacttggttcagatgtcagaggaaagcagaaaatggtgtctctggcatagtaaagaaaattgttgaaatttcccaaaggaagagtcatagcctggatgactgcaagtgccttctttggcttgggggttcagttactagttagagtcaggggaacttccacaggacttcctttgactctccaaacaagctgaagccccagaccccttggaaggatggatacaaagtaggtactagaacagtctttgtcatcaaatatggtatttctcaggtgtcacctctgtgttcagagctaccctgagccctctgccatgtaagctctctgatggcacagatttttatctggcttgttttctgccgttatcttagaagctagaatagtgtctggaacatcatgggtattcaatgaatatttaaataaatagatgaaattagatataagaaactaggtgcttaaacaggcaggaggtaatctgggaaaagagcagttagtttggaatcagaattcttggtgtgtcatccagcattatgtgagttttaggctaaatacagcctttctgagtctctatctgctcatttaagaaacagagacaatactgctcagggttgttgtgaatgttaaaggtacatggtaaaaaagaaagtatttgtgttttgtaaacatttgaattgataagaggacagtgtgagacaaaaataaaatcctgggtgggcacggtggctcacccctgtaatctcagcactttgggaggctgagatgggaggatcacgaggtcaggagtgcgagaccagcctggccaatatggtgaaaccacgtctctgctaaaaatacaaaaattagctgggcgtggtggcacgtgcctgtagtcccagctacgccggaggctgaggcagaagaatcgctcgaacctgggagatggagtttgcagtgagctgagatcacgccactgcactccagcctaggcaactgagtgagactccatctcaaaataaaataaaatagaatagaataaaataaaatcctttccacatatatgcggaaattttatgtatgataaaaggggcctattagtctttgggaaaggaatggatggatgatgagaaagtaggctcatttgacaaagagaaacaaaattagattcctattttaacacgcaacaaagatgaattccaaaatacctattgggtactatgcttattacctgagtgacgaaataatctgtacagcaaactcctgtgacacaccatttaactacataacaaacctgcatacgtacccctgaaactaaagtagaagttaaaaccatcaacccccccaaaacaaaaatgaattccatctgaataaaaggtataaatgtgaaagtcatcatgctaatagatattatgaaatataaattcaaaacctgtataaaaactgaaaaaatgtaaaacgtcacaattagaataagaaaatttaaatagaacaatgaatattaaataaactaaaatgctaataaaatgtactccttagggccaggtgcggtggctcacacctgtaatcccagcactttgggaggccgaggtgggtggatcacctgaggtcaggagtttgagaccagcctggccaatgtggtgaaaccctgtctctactaaaaatacaaaaagttagccaggtgtgatggtgggcacctgtaatcccagctacttgggaggctgaggtaggaaaatcacttgaacccagaaggcagaagttgcagtgagcctagatcacggcactacactccagcctgggcaacaagagcaaatctctatctcaaaaaaaaaaaaaaaaaaaaaaaggccacagaaatgtccatccagcaggtggacaattacccttttgtcagccgttcctctgttgctgaccattagatccacatttcttttctgtccgccctggtcccctggtgccccctttcctggcccctgtgacatattgtcatgtagctccaagtatttccccccctcatatccctcaagtgctccattttccaaatgcatttgacttcctactctcttagccccagctctctggtattctgtgtagctgacttccacaagggatctgttgggagcttgtaactgaactgaagtcatgcacattgtcaatggctagtagacctttacctggtccagagttgtctgcattgtttaaagaagacgtttgttaatccaaattaatctttgatttgcatggaggcagtaggtcaaatcaaaaggaaattttcctctccctagcaagcaaactcagaaacaaacaaacaaacgaaaaccaagaaacaaaaggaaaggttcctgttgggatagagaaacagtggagcagggcagccaccttacacataggctagatctgcttgggaatctttcttctaatcgaggcccctaaaatattcctgattttcacagttgatttcatttcttccctcctgaacttacagagcctttcagtaaacaccagtatttgtccctccccgtgtatgcccagtggtttccatggcagcaacggttgccatagagaggtgaagagaggtgtcggtgccctcttttgtaactgtgggttatctatagattgggggtggcctctcctaaaaaagactaatatgtaaataaaaggaataagaatcaaacaaatataaatcagggctcaagtcatttgttttcctaaacctttgtggttatccataccatttaaccttgactttccttaaatcataccggtgcgtgtgtgtgtgcagagggaaagggctgcaagaagactctggaagctaggacaggtctcagcaggtgagggctcaggcccagaggccagctggggcagcagggagcagagttatctgggccatttgctaattatctcagcccagacgagtctgcacgctatgtggtttaataccttcaccagaggcaaatggttttggactcacaagaattgctcatggccagaggcaatggacagatgccatatgagaaagggctgaggccaggaacagaggcagggttatctcactggaatggagaagctaaaatgacattatctttacttctgccctggttattatcccaaggcaacttcagtgggcttgttttgaagtcaaagcctcaactatttattgtgagggagataattcattttcattttcctgccagagatgtcagtcttactattcatcctgtatcctctattagatacacagagcttcttccttctgcttaggctgccccaaattccatataggattctttttgaagaatatatatcatccaaaaagaggtcctaggaaatgtggcttcacaaccctggggtttgtttccctggctgctgtctctctctctctcttttttaattttttttggagacacggtatcactgtgtggcccaggctggagtgtggtggcgccatcactgctcactgcagcctcgacctcctgggctcaagcagtcctcccacttcagcctcccaaatagctgggactacaggtgtactccactatgcctggctacattttgaattttttgtagagatggggttttgccatgttgctcaggttggtctcaaactcctgggctcaagcaatccacccaacttggcctcccaaagtgctgggattagaggcatgagccatcaggcctggccatgctgcctctctctccttcaaggtagacttcctctttccttccccttctccctgcttctttctccttctcctctccttctcctcttctccttcttcttctcacagctttttattgacttataacaggcacacaataaactgcacacaggtaaatcatataatttgacattttggtacaggaaatcatcatgaaactgaaagcattaccacatcgagattgtgaacataccaccaccagaagttttcttgtgcccctttgtaattcttcccactgccctctccccaggttgtccctgatctgctttttgtccttgtagattagttgcattttctagaattttgtataagtggagtgtatctacagtatgttctcttttgtgtctgccttcttgtactcagcataattattttgagattcatccacgtctttgcatggatcagtcatctgttccattttattgctaagcagtattccactgtatagataaataacattttgtttatccgtttacttgttgatgaactttaagttgtttccagttttgagttattagagtaatgctactatgaacatttgcatatgaatccttgtatggacatgaactttcatttcttttgggagtaggatagctggatcatatggaatgtatatgtttaacttttaaataaactgccaaactgttttcc

SEQ ID NO: 149410 - DNA, 1760 bp, Homo sapiens
  Payload ID: 9496
  Gene Symbol: LIPG
  Gene Name: lipase, endothelial
  ENST ID: ENST00000427224
  CDS Start-End: 250-1530
agcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacagcaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgt

SEQ ID NO: 149411 - DNA, 1453 bp, Homo sapiens
  Payload ID: 9496
  Gene Symbol: LIPG
  Gene Name: lipase, endothelial
  Uniprot ID: Q9Y5X9
  ENST ID: ENST00000580036
  CDS Start-End: 223-1287
ggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagaggtaaccttcagtccctggagtgtccctgaggaaggcccttaatacctccttcttaataccatgctgcagagcagggcacatcctagcccaggagaagtggccagcacaatccaatcaaatcgttgcaaatcagattacactgtgcatgtcctaggaaagggaatctttacaaaataaacagtgtggacccctttt

SEQ ID NO: 149412 - DNA, 565 bp, Homo sapiens
  Payload ID: 9496
  Gene Symbol: LIPG
  Gene Name: lipase, endothelial
  ENST ID: ENST00000579750
  CDS Start-End: 1-565
ctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggtactgggggatgagagggagtctcctgtcaccagcaggatctcaaacccaatcttcttaagaaatgcaggtcatgcatctgttgccatgaacttctggagtctgataaaaatctttgagattaaaagttttattgaattaa

SEQ ID NO: 149413 - DNA, 505 bp, Homo sapiens
  Payload ID: 9496
  Gene Symbol: LIPG
  Gene Name: lipase, endothelial
  ENST ID: ENST00000583083
  CDS Start-End: 433-505
cagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagttttcccaacatccctaagccgccgatacattatcacccacgtattgcggacgagagaaccgcctcggagaagctggctggctcgcttggagttttgcagctagtggcggagcgagcattccgagcagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaac

SEQ ID NO: 149414 - DNA, 2323 bp, Homo sapiens
  Payload ID: 9496
  Gene Symbol: LIPG
  Gene Name: lipase, endothelial
  ENST ID: ENST00000577628
  CDS Start-End: 988-2160
aatgaggcgaggtcggaacaggatctgctggctccggctcggtttcctcgcacaggtctctccagctggatcctcgacgctagggaggaaggggcgcgggactgctgtgggggttttccctccccaggcaggggcaggacctgttccgggcgactgcagggttaagggtatcgtcttaaagagccggatcctcccggctggagcgaggctggatggcgggacgcagcctctcagcctctcgtacccgccctgcgtccgcagtggttgttggcgcagccgccccgtcggtgttccgggctcagtccccgctccccagcgccagacgcagactccgggccaagttctccctccgctcgctgctttctgccgcaggacccggatcaataaagggaaggagagccgggaggaaatgatggagaacagagagaaaggagatgcttgatttcactcgccaaggagtgagtgctcatcggcagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagttttcccaacatccctaagccgccgatacattatcacccacgtattgcggacgagagaaccgcctcggagaagctggctggctcgcttggagttttgcagctagtggcggagcgagcattccgagcaggtactgtgcgatcctccagcgccggccgcagctcacagccccttagctccgccgggttattgtgcggccgcgccttctgcacctgttgcggccctcgctaggcgggaagggagggagaagaggaggacaaaggggatgaccaggtggctctcccccgacggactcccggcccagggagcggatagaccactcccagagagagtgtggctttgagccttggagaggatgctctccttctccagggatcgcctccccagcggacgcagagtttcagggaaatgtccgcctccgccacttgggatggcagtggggagaggaggatctgggtgtccggaggagggcagtgggagaaagctggagctgctggagtcgcagctgcctgcggagcgggcccgggaggaagcggggccgagcgtgcggcgtccacgcgataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagaggtaaccttcagtccctggagtgtccctgaggaaggcccttaatacctccttcttaataccatgctgcagagcagggcacatcctagcccaggagaagtggccagcacaatccaatcaaatcgttgcaaatcagattacactgtgcatgtcctaggaaagggaatctttacaaaataaacagtgtggacccct

SEQ ID NO: 149415 - DNA, 1484 bp, Homo sapiens
  Payload ID: 9497
  Gene Symbol: LIPJ
  Gene Name: lipase, family member J
  Uniprot ID: Q5W064
  ENST ID: ENST00000371939
  CDS Start-End: 315-1415
agagactatgagggttcactatctgtttgctggaagatatacaagacttttgaggataatacttaaatgaagatagaccggatgtataatatgctttttcttagctttcctatgactctacttagcaacttttgctaaaagaaacacaatatatgactgactactttgaagacacatatattggacacttaaaatcaacaaaagcagagaggtcccaaacgtggtatcttttcacaatgatgtattttatccgaattcttggaattactcatggtgtctttcaaaattaaagatctgtgaaacctgaagcagatatgaatattagccagattatttcctactggggctaccctgatgaagaatatgatattgtaaccgaagatggttatatccttggcctttatagaattccttattggaggacagacaataataaaaatctagctcagagggttgttgtatacttgcaacatggtttgcttacatctgccagcagctggatttccaatcttcccaacaatagtctgggcttcattctggcagatgctggttatgatgtgtggatgggaaatagcagaggaaatacctggtccaggaaacacttgtacctagaaacgagttccaaagaattctgggctttcagttttgatgagatggcaaaatatgaccttccagcctctattgatttcactgtgaagcaaaccagacaagaggaaatattttatgtaggccattcacagggtactactattggtttcataacattttctactatatcaaagatagctgaaagaatcaaaatattttttgctttagcaccagttttttccacaaagtacttaaaaagtcctttaattagaatgacatacaaatggaagtcaatagtcatggctttttcaggcaacaaagacttcttgcctaaaacctcatttaaaaaattcattggttcaaagctgtgtccactacagatttttgataagatttgcctcaatatcttgtttatgatgtttggatatgacccaaaaaacttaaatatgagtcgtttggatgtgtatttttcacacaacccagcaggaacatctgttcaaaatatgcttcattggagtcagcttttaaattctactcatttgaaagcttatgactggggcagtcctgatctgaacttggttcattataatcagacaacgtctccattatacaacatgacaaacatgaatgtggcaactgcaatttggaatggtaaaagtgacttgttggctgaccctgaagacgttaacattttacattctgaaatcacaaaccacatttattataaaactatttcttactacaatcatatagactctttgtttggattagatgtctatgatcaagtttaccatgaaatcattgatattatccaagacaatctataaagaaccatggcgctgtgtgtttaaagatctacatcattcctaatgaaatccaattcttattttttttta

SEQ ID NO: 149416 - DNA, 462 bp, Homo sapiens
  Payload ID: 9497
  Gene Symbol: LIPJ
  Gene Name: lipase, family member J
  ENST ID: ENST00000531458
  CDS Start-End: 1-462
tatgtaggccattcacagggtactactattggtttcataacattttctactatatcaaagatagctgaaagaatcaaaatattttttgctttagcaccagttttttccacaaagtacttaaaaagtcctttaattagaatgacatacaaatggaagtcaatagtcatgagtcgtttggatgtgtatttttcacacaacccagcaggaacatctgttcaaaatatgcttcattggagtcagcttttaaattctactcatttgaaagcttatgactggggcagtcctgatctgaacttggttcattataatcagacaacgtctccattatacaacatgacaaacatgaatgtggcaactgcaatttggaatggtaaaagtgacttgttggctgaccctgaagacgttaacattttacattctgaaatcacaaaccacatttattataaaactatttcttactac

SEQ ID NO: 149417 - DNA, 1230 bp, Homo sapiens
  Payload ID: 9498
  Gene Symbol: LIPK
  Gene Name: lipase, family member K
  Uniprot ID: Q5VXJ0
  ENST ID: ENST00000404190
  CDS Start-End: 1-1200
atgtggcagcttttagcagcagcatgctggatgcttcttcttggatctatgtatggttatgacaagaaaggaaacaatgcaaaccctgaagctaatatgaatattagccagattatttcttactggggttatccttatgaagagtatgatgttacaacaaaagatggttatatccttggaatttataggattccacatggaagaggatgcccagggaggacagctccaaagcctgctgtgtatttgcagcatggcttaattgcatctgccagtaactggatttgcaacctgcccaacaacagtttggctttccttctggcagatagtggttatgacgtgtggttggggaacagccgaggaaacacttggtccagaaaacaccttaaattgtcaccgaaatcaccggaatactgggccttcagtttggatgagatggctaaatatgaccttccagccacaatcaattttatcatagagaaaactggacagaagcgactctactacgtgggccactcacaaggcaccaccatagcttttatagcattttctacaaacccagaactggctaaaaagattaagatattttttgcactggctccagttgtcacagttaaatacacccaaagtcctatgaaaaaactaacaaccctttccaggcgagtagttaaggtgttgtttggtgacaaaatgttccaccctcatacattgtttgaccaattcattgccaccaaagtgtgcaatcgaaagctattccgtcgtatttgcagcaacttcctatttactctgagtggatttgatccgcaaaacttaaatatgagtcgcttggatgtttatttgtcacacaatcctgcgggaacatctgttcagaatatgctgcactgggctcaggctgttaattctggtcagctccaagcttttgattggggaaactctgatcagaacatgatgcacttccatcagcttacacctcctttatacaacattactaagatggaagttccaacagcaatatggaatggtggacaggacattgtggctgatcccaaggatgttgaaaatttacttcctcaaattgctaaccttatttattacaagctgattccacactacaatcatgtggatttttaccttggagaggatgcacctcaggaaatttaccaagacctaattatattgatggaagaatatttacaaaattaaatgcactttactttctctaagcaagtggat

SEQ ID NO: 149418 - DNA, 1439 bp, Homo sapiens
  Payload ID: 9499
  Gene Symbol: LIPM
  Gene Name: lipase, family member M
  Uniprot ID: Q5VYY2
  ENST ID: ENST00000404743
  CDS Start-End: 168-1439
ctactttgtgttctttccctaccaactaagcttgcctaatttgcttcagaattggaagagggaattgcagcaggaaaatatgtgaagagtttttaaacccacaaattcttcttactttagaattagttgttacattggcaggaaaaaataaatgcagatgttggaccatgttggaaaccttgtcaagacagtggattgtctcacacagaatggaaatgtggcttctgattctggtggcgtatatgttccagagaaatgtgaattcagtacatatgccaactaaagctgtggacccagaagcattcatgaatattagtgaaatcatccaacatcaaggctatccctgtgaggaatatgaagtcgcaactgaagatgggtatatcctttctgttaacaggattcctcgaggcctagtgcaacctaagaagacaggttccaggcctgtggtgttactgcagcatggcctagttggaggtgctagcaactggatttccaacctgcccaacaatagcctgggcttcattctggcagatgctggttttgacgtgtggatggggaacagcaggggaaacgcctggtctcgaaaacacaagacactctccatagaccaagatgagttctgggctttcagttatgatgagatggctaggtttgaccttcctgcagtgataaactttattttgcagaaaacgggccaggaaaagatctattatgtcggctattcacagggcaccaccatgggctttattgcattttccaccatgccagagctggctcagaaaatcaaaatgtattttgctttagcacccatagccactgttaagcatgcaaaaagccccgggaccaaatttttgttgctgccagatatgatgatcaagggattgtttggcaaaaaagaatttctgtatcagaccagatttctcagacaacttgttatttacctttgtggccaggtgattcttgatcagatttgtagtaatatcatgttacttctgggtggattcaacaccaacaatatgaacatgagccgagcaagtgtatatgctgcccacactcttgctggaacatctgtgcaaaatattctacactggagccaggcagtgaattctggtgaactccgggcatttgactgggggagtgagaccaaaaatctggaaaaatgcaatcagccaactcctgtaaggtacagagtcagagatatgacggtccctacagcaatgtggacaggaggtcaggactggctttcaaatccagaagacgtgaaaatgctgctctctgaggtgaccaacctcatctaccataagaatattcctgaatgggctcacgtggatttcatctggggtttggatgctcctcaccgtatgtacaatgaaatcatccatctgatgcagcaggaggagaccaacctttcccagggacggtgtgaggccgtattgtga

SEQ ID NO: 149419 - DNA, 1197 bp, Homo sapiens
  Payload ID: 9499
  Gene Symbol: LIPM
  Gene Name: lipase, family member M
  Uniprot ID: Q5VYY2
  ENST ID: ENST00000539337
  CDS Start-End: 1-1152
atgaccaggcctttagaccgcaaacagagtgaaatcatccaacatcaaggctatccctgtgaggaatatgaagtcgcaactgaagatgggtatatcctttctgttaacaggattcctcgaggcctagtgcaacctaagaagacaggttccaggcctgtggtgttactgcagcatggcctagttggaggtgctagcaactggatttccaacctgcccaacaatagcctgggcttcattctggcagatgctggttttgacgtgtggatggggaacagcaggggaaacgcctggtctcgaaaacacaagacactctccatagaccaagatgagttctgggctttcagttatgatgagatggctaggtttgaccttcctgcagtgataaactttattttgcagaaaacgggccaggaaaagatctattatgtcggctattcacagggcaccaccatgggctttattgcattttccaccatgccagagctggctcagaaaatcaaaatgtattttgctttagcacccatagccactgttaagcatgcaaaaagccccgggaccaaatttttgttgctgccagatatgatgatcaagggattgtttggcaaaaaagaatttctgtatcagaccagatttctcagacaacttgttatttacctttgtggccaggtgattcttgatcagatttgtagtaatatcatgttacttctgggtggattcaacaccaacaatatgaacatgagccgagcaagtgtatatgctgcccacactcttgctggaacatctgtgcaaaatattctacactggagccaggcagtgaattctggtgaactccgggcatttgactgggggagtgagaccaaaaatctggaaaaatgcaatcagccaactcctgtaaggtacagagtcagagatatgacggtccctacagcaatgtggacaggaggtcaggactggctttcaaatccagaagacgtgaaaatgctgctctctgaggtgaccaacctcatctaccataagaatattcctgaatgggctcacgtggatttcatctggggtttggatgctcctcaccgtatgtacaatgaaatcatccatctgatgcagcaggaggagaccaacctttcccagggacggtgtgaggccgtattgtgaagcatctgacactgacgatcttaggacaacctcctgagggatggg

SEQ ID NO: 149420 - DNA, 1197 bp, Homo sapiens
  Payload ID: 9500
  Gene Symbol: LIPN
  Gene Name: lipase, family member N
  Uniprot ID: Q5VXI9
  ENST ID: ENST00000404459
  CDS Start-End: 1-1197
atgatgtggctgcttttaacaacaacttgtttgatctgtggaactttaaatgctggtggattccttgatttggaaaatgaagtgaatcctgaggtgtggatgaatactagtgaaatcatcatctacaatggctaccccagtgaagagtatgaagtcaccactgaagatgggtatatactccttgtcaacagaattccttatgggcgaacacatgctaggagcacaggtccccggccagttgtgtatatgcagcatgccctgtttgcagacaatgcctactggcttgagaattatgctaatggaagccttggattccttctagcagatgcaggttatgatgtatggatgggaaacagtcggggaaacacttggtcaagaagacacaaaacactctcagagacagatgagaaattctgggcctttagttttgatgaaatggccaaatatgatctcccaggagtaatagacttcattgtaaataaaactggtcaggagaaattgtatttcattggacattcacttggcactacaatagggtttgtagccttttccaccatgcctgaactggcacaaagaatcaaaatgaattttgccttgggtcctacgatctcattcaaatatcccacgggcatttttaccaggttttttctacttccaaattccataatcaaggctgtttttggtaccaaaggtttctttttagaagataagaaaacgaagatagcttctaccaaaatctgcaacaataagatactctggttgatatgtagcgaatttatgtccttatgggctggatccaacaagaaaaatatgaatcagagtcgaatggatgtgtatatgtcacatgctcccactggttcatcagtacacaacattctgcatataaaacagctttaccactctgatgaattcagagcttatgactggggaaatgacgctgataatatgaaacattacaatcagagtcatccccctatatatgacctgactgccatgaaagtgcctactgctatttgggctggtggacatgatgtcctcgtaacaccccaggatgtggccaggatactccctcaaatcaagagtcttcattactttaagctattgccagattggaaccactttgattttgtctggggcctcgatgcccctcaacggatgtacagtgaaatcatagctttaatgaaggcatattcctaa

SEQ ID NO: 149421 - DNA, 1376 bp, Homo sapiens
  Payload ID: 9501
  Gene Symbol: LIPF
  Gene Name: lipase, gastric
  Uniprot ID: P07098
  ENST ID: ENST00000238983
  CDS Start-End: 47-1243
agagaaacagaatcctaactatttctgaggaaactgcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaa

SEQ ID NO: 149422 - DNA, 1357 bp, Homo sapiens
  Payload ID: 9501
  Gene Symbol: LIPF
  Gene Name: lipase, gastric
  Uniprot ID: P07098
  ENST ID: ENST00000355843
  CDS Start-End: 97-1224
gagaaacagaatcctaactatttctgaggaaactgacttggcaacaagcattttgagaaatttattctgcccttgaacatctttgagcccattgagatgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaacaaa

SEQ ID NO: 149423 - DNA, 1470 bp, Homo sapiens
  Payload ID: 9501
  Gene Symbol: LIPF
  Gene Name: lipase, gastric
  Uniprot ID: P07098
  ENST ID: ENST00000394375
  CDS Start-End: 114-1340
aaaatactaaccagccagagaaacagaatcctaactatttctgaggaaactgacttggcaacaagcattttgagaaatttattctgcccttgaacatctttgagcccattgagatgttctccaacgcaaacagcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacaggccagagacctgttgtgtttttgcagcatggtttgcttgcatcagccacaaactggatttccaacctgccgaacaacagccttgccttcattctggcagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaac

SEQ ID NO: 149424 - DNA, 1290 bp, Homo sapiens
  Payload ID: 9501
  Gene Symbol: LIPF
  Gene Name: lipase, gastric
  Uniprot ID: P07098
  ENST ID: ENST00000608620
  CDS Start-End: 63-1160
aaaatactaaccagccagagaaacagaatcctaactatttctgaggaaactgcaggtccaaaatgtggctgcttttaacaatggcaagtttgatatctgtactggggactacacatggtttgtttggaaaattacatcctggaagccctgaagtgactatgaacattagtcagatgattacttattggggatacccaaatgaagaatatgaagttgtgactgaagatggttatattcttgaagtcaatagaattccttatgggaagaaaaattcagggaatacagatgctggttatgatgtgtggctgggcaacagcagaggaaacacctgggccagaagaaacttgtactattcaccagattcagttgaattctgggctttcagctttgatgaaatggctaaatatgaccttccagccacaatcgacttcattgtaaagaaaactggacagaagcagctacactatgttggccattcccagggcaccaccattggttttattgccttttccaccaatcccagcctggctaaaagaatcaaaaccttctatgctctagctcctgttgccactgtgaagtatacaaaaagccttataaacaaacttagatttgttcctcaatccctcttcaagtttatatttggtgacaaaatattctacccacacaacttctttgatcaatttcttgctactgaagtgtgctcccgtgagatgctgaatctcctttgcagcaatgccttatttataatttgtggatttgacagtaagaactttaacacgagtcgcttggatgtgtatctatcacataatccagcaggaacttctgttcaaaacatgttccattggacccaggctgttaagtctgggaaattccaagcttatgactggggaagcccagttcagaataggatgcactatgatcagtcccaacctccctactacaatgtgacagccatgaatgtaccaattgcagtgtggaacggtggcaaggacctgttggctgacccccaagatgttggccttttgcttccaaaactccccaatcttatttaccacaaggagattcctttttacaatcacttggactttatctgggcaatggatgcccctcaagaagtttacaatgacattgtttctatgatatcagaagataaaaagtagttctggatttaaagaattatccgtttgtttttccaaaatactttattctctcatacatagtattttcataatgtttgacatgcagtgcttctttctgtaattttgactttagaaatatattggcatcaac

SEQ ID NO: 149425 - DNA, 2751 bp, Homo sapiens
  Payload ID: 9502
  Gene Symbol: LIPC
  Gene Name: lipase, hepatic
  Uniprot ID: P11150
  ENST ID: ENST00000299022
  CDS Start-End: 236-1735
ttttattctcaaaatgtgtcaggataagaagcacttctgtaaatcgacctttttaaaatagatataattagatttgcagttgggggcagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggaatctgtgcaactctctcgaagccatgttcacctaattgggtacagcctgggtgcacacgtgtcaggatttgccggcagttccatcggtggaacgcacaagattgggagaatcacagggctggatgccgcgggacctttgtttgagggaagtgcccccagcaatcgtctttctccagatgatgccaattttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatgccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaagtttatcattaccagttcaagatccagttcatcaaccaaactgagacaccaatacaaacaacttttaccatgtcactactcggaacaaaagagaaaatgcagaaaattcccatcactctgggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttatctggaatggctgccttatttagaagccaaaattacataaagaatctcacacaaagcttaaataaagtttagatttaaggggggtatgtttcactctcataaactgagcttttaaaaacgatatgatataactattttccagtatcagtacaaccaaaaatgtcccaattttatctctggttaaatgttaatatatgcaaataagtacaaatgcaagagccattttagatctgttgttctaatttacaatgtcttttataattaagtttcccacatgtccttgctagtttattatgacccatttttgaaccatgctagaaagatacttttttattaggtaactagtgcttcaataaagcaagattctaattaatcaccactagttgtgtataccaaatacacatcctttaagacaatacagttcttaaaagaagaaaaattataattattctaatatttatacaaatcatataacgatttcacagaaccaaacacttacaagtagaattctactaaaactacttgtgataacagtgaaagctagacatgtggtcattttaataatggaattacaaattaaataaacataattattatatcttactaatgcttgcaacaaaagctaattttaaaaacttggaatgtctcaaagcatttgctatggactgaatgtttgagtcaccccaaaattcatatgctgaaatctaatccccaatgtgatggtgtttggaggtggggcctttgggaggtgatcaggtcatgagggtggagccctcataagtgggattagtgcccttataggggataaaggatcagaactctctgccatgtgcggatatgagaaggcaactatatgcaaaccaggaagttgaccctcacctggaagtagactaccagatctgctggcacctttatcttggacttctcagcttccagaactgtgagaaataaatgtttcttgtttaagcc

SEQ ID NO: 149426 - DNA, 2161 bp, Homo sapiens
  Payload ID: 9502
  Gene Symbol: LIPC
  Gene Name: lipase, hepatic
  Uniprot ID: P11150
  ENST ID: ENST00000356113
  CDS Start-End: 616-2115
gatgagaattgccaaggcacagcaaagcctgcagcttccatacccgtcatgagagcaaataacttatttgtaaacctaagcacttaattaactaaatggaaagcaaggcagtgagtgattcctgacatggccgaatttaagtcaagctgtgaagctccaggtgcagccagaaatggagatggacaacttgaactgaaccctgagagcttctaaaaaggctttggaccactgcttctcagcagtttttcttacggagtctctctgtgtcgcccaggctggagtacaatggcgcgatctcagttcactgcaacctccgcctcccaggttcaagcgattctcctgcctcagcttcctgagtagctgggattacaggcactcacctccacgcccagctaacttttgtatttttagtacagatggggtttcaccatgttggtcaggctggtctcgaactcctgacctcgtgatccgccctcctcgcctcccaaagtgctgtgattacaggagtgagccaccgctcctggccagaaatctcttctttattatgtctactgtccgttatccaactccagaagaaattaccaagaaagcctggaccccgggtgaaacggagaaatggacacaagtcccctgtgtttctccattctgttggttttatgcatctttatccaatcaagtgcccttggacaaagcctgaaaccagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggaatctgtgcaactctctcgaagccatgttcacctaattgggtacagcctgggtgcacacgtgtcaggatttgccggcagttccatcggtggaacgcacaagattgggagaatcacagggctggatgccgcgggacctttgtttgagggaagtgcccccagcaatcgtctttctccagatgatgccaattttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatgccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaagtttatcattaccagttcaagatccagttcatcaaccaaactgagacaccaatacaaacaacttttaccatgtcactactcggaacaaaagagaaaatgcagaaaattcccatcactctgggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactcctt

SEQ ID NO: 149427 - DNA, 1484 bp, Homo sapiens
  Payload ID: 9502
  Gene Symbol: LIPC
  Gene Name: lipase, hepatic
  ENST ID: ENST00000433326
  CDS Start-End: 43-1359
agaaattaccaagaaagcctggaccccgggtgaaacggagaaatggacacaagtcccctgtgtttctccattctgttggttttatgcatctttatccaatcaagtgcccttggacaaagcctgaaaccagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggaatctgtgcaactctctcgaagccatgttcacctaattgggtacagcctgggtgcacacgtgtcaggatttgccggcagttccatcggtggaacgcacaagattgggagaatcacagggctggatgccgcgggacctttgtttgagggaagtgcccccagcaatcgtctttctccagatgatgccaattttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatgccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaagtttatcattaccagttcaagatccagttcatcaaccaaactgagacaccaatacaaacaacttttaccatgtcactactcggaacaaaagagaaaatgcagaaaattcccatcactctgggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttatctggaatggctgccttatttagaagccaaaattacataaagaatctcacacaaagcttaaataaagtttagatttaa

SEQ ID NO: 149428 - DNA, 2968 bp, Homo sapiens
  Payload ID: 9502
  Gene Symbol: LIPC
  Gene Name: lipase, hepatic
  ENST ID: ENST00000414170
  CDS Start-End: 288-1787
gagaattgccaaggcacagcaaagcctgcagcttccatacccgtcatgagagcaaataacttatttgtaaacctaagcacttaattaactaaatggaaagcaaggcagtgagtgattcctgacatggccgaatttaagtcaagctgtgaagctccaggtgcagccagaaatggagatggacaacttgaactgaaccctgagagcttctaaaaaggctttggaccactgcttctcagcagtttttcttaaattaccaagaaagcctggaccccgggtgaaacggagaaatggacacaagtcccctgtgtttctccattctgttggttttatgcatctttatccaatcaagtgcccttggacaaagcctgaaaccagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggaatctgtgcaactctctcgaagccatgttcacctaattgggtacagcctgggtgcacacgtgtcaggatttgccggcagttccatcggtggaacgcacaagattgggagaatcacagggctggatgccgcgggacctttgtttgagggaagtgcccccagcaatcgtctttctccagatgatgccaattttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatgccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaagtttatcattaccagttcaagatccagttcatcaaccaaactgagacaccaatacaaacaacttttaccatgtcactactcggaacaaaagagaaaatgcagaaaattcccatcactctgggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaagatctcccaacaggatcaatctgggaagattaaactgctcgctcctcttctgcactgagctcttctcacatgactctttggcccattggagcagcgctgcttctgagctctgaccctgcccagatgctcttagctggagagtaattcctcagtttaggtggctgctcaccctgacaatcccatgtggcttgacctgaaagggtggctaaagcacaacactaccttctccactggggcacacccatgtggtacggaagaagaaatgaggagagggaggggcctggcccttccagggctcccacacggggtgagcattgaagcaggtgctccatggcattggtctcacgtgatctttgctgtgatcctgaaatgggtagtattggctgtgcagattaggaacctgaggctcacagaagttacacagcttgaggacattgctcaaaattgtcccagtccagatttgactgggatttgtctgatttattacccatttgttgggggtgtgctgtttccaacagttccttcttccattagttttggttccattaatctgaattttctcagtctaatctagcagagttgcagtgctggacattaacatatgtatgcatcaaacccatccttagggctgtaggaggtactgtatgcgggttatgggagctataattttttttaggttgtaaataccgagtgcctcctctgtgtctacacagtgccaggtactatcggagaatacaaaaaaaaaaaaaaaaatctgagttgtggctcttggtagaaataaactccaggacctaaccaggaaaataagatgaattaattttactaacggtgtggtccatcccagggcttctcaaactttcacgagcatacaaagcatctgggaatcatgttaaaatgcaggttctgctttagtgagtctggggtgagcctgatgttctgcatttctaacaagcgaccaggcaatgctgttgctgcaggtcaacagaccacactttgaatagtgagagtccagcattacacaacccgggaagtgtaagaagaaagttcagacccgtacacttggggctgtgctgcaacatgctttgaggaggccaagaggtgttcccagggagacaggcagccggcaaagcaatatggctggcaggatcggatggactccagtgtcagccagtcctaaactcacattttaacttcactgctcacaatctgtgtagcctcaaacaataacttcactcttcaagactcagttgtttagtgataaacgagaatcataatatacatttcatgagactaa

SEQ ID NO: 149429 - DNA, 3813 bp, Homo sapiens
  Payload ID: 9503
  Gene Symbol: LIPE
  Gene Name: lipase, hormone-sensitive
  Uniprot ID: Q05469
  ENST ID: ENST00000244289
  CDS Start-End: 278-3508
cttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcacagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggc

SEQ ID NO: 149430 - DNA, 335 bp, Homo sapiens
  Payload ID: 9503
  Gene Symbol: LIPE
  Gene Name: lipase, hormone-sensitive
  ENST ID: ENST00000601189
  CDS Start-End: 95-335
tgagagacgggaatggccgctgccaggccccaggacctagaagggaaaggaaataccttcttctaggggaacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgct

SEQ ID NO: 149431 - DNA, 759 bp, Homo sapiens
  Payload ID: 9503
  Gene Symbol: LIPE
  Gene Name: lipase, hormone-sensitive
  ENST ID: ENST00000597001
  CDS Start-End: 232-759
gatcggcttgggagcagagtccggaatgcgagcttcgtggaccagggttcccgctcggattccgtattcgctgtgtgaccaagggcaacggatgccctcagtgtttcccacctggggaatgcttcaagcgccgatgttcagggctccagcgctcttgagaggataagggggaaggaggttagcaggtgttactcaaagaggaagtctagcgcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgcc

SEQ ID NO: 149432 - DNA, 915 bp, Homo sapiens
  Payload ID: 9503
  Gene Symbol: LIPE
  Gene Name: lipase, hormone-sensitive
  ENST ID: ENST00000597620
  CDS Start-End: 1-915
ggaggagtgcttcttcgcctactgctgggccatcaagcactgcgccctccttggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgaca

SEQ ID NO: 149433 - DNA, 1367 bp, Homo sapiens
  Payload ID: 9503
  Gene Symbol: LIPE
  Gene Name: lipase, hormone-sensitive
  ENST ID: ENST00000599783
  CDS Start-End: 588-1367
agacaggagagggaaagcggggctccctcctccaacggctctcaggcacagccacgcctccagcgctggcgccccgcctcgtctttgagttggcagaggacctggcccgcccccaccccaggcagaggctcagaggcgccccactttcccccttcaaaaggcgggccgggccgcgtgctagggcatccctccctgggaaggtgagtgggatggcgagactgagccagcacatgggaggcttcccagcacgtgggaagatcgggacttccctgctggggtgctccccgcggggctccgcactagtcctgcccgaaggacgcttttcgccacccccggggttgcctttttgttggccgcgagccctttaatgcgcggtagggggcggagccagatcttaaattctggcggttgggggcggagcacggcagcggagggagaccagaattggttagggagctggacccagagaagagcaagctcgggattgggtaataggggggcccgacagtagtgtgtagcgaggattggccctccgggcagggcctcgcggctggaattggcccccgcgggaggaccgcggggaattgatggagttggccgggggaacggagcccgccgaggccgctatggccccggcctcgaagaatgccaaagagggctcaaggagccacggtcgccggcggtggcgaaaagacaaggccaaagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgc

SEQ ID NO: 149434 - DNA, 824 bp, Homo sapiens
  Payload ID: 9503
  Gene Symbol: LIPE
  Gene Name: lipase, hormone-sensitive
  ENST ID: ENST00000599918
  CDS Start-End: 1-824
ttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcaggcctatctgctctccctctctcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatg

SEQ ID NO: 149435 - DNA, 738 bp, Homo sapiens
  Payload ID: 9503
  Gene Symbol: LIPE
  Gene Name: lipase, hormone-sensitive
  ENST ID: ENST00000599211
  CDS Start-End: 72-738
gggtttattgccccaggctgctactggcacaagccacagaccagcagtcccagcccagggaagctcggaagatgcctaggagggcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcacca

SEQ ID NO: 149436 - DNA, 4026 bp, Homo sapiens
  Payload ID: 9504
  Gene Symbol: LIPH
  Gene Name: lipase, member H
  Uniprot ID: Q8WWY8
  ENST ID: ENST00000296252
  CDS Start-End: 143-1498
agtccctagggaacttcctgttgtcaccacacctctgagtcgtctgagctcactgtgagcaaaatcccacagtggaaactcttaagcctctgcgaagtaaatcattcttgtgaatgtgacacacgatctctccagtttccatatgttgagattctacttattcatcagtttgttgtgcttgtcaagatcagacgcagaagaaacatgtccttcattcaccaggctgagctttcacagtgcagtggttggtacgggactaaatgtgaggctgatgctctacacaaggaaaaacctgacctgcgcacaaaccatcaactcctcagcttttgggaacttgaatgtgaccaagaaaaccaccttcattgtccatggattcaggccaacaggctcccctcctgtttggatggatgacttagtaaagggtttgctctctgttgaagacatgaacgtagttgttgttgattggaatcgaggagctacaactttaatatatacccatgcctctagtaagaccagaaaagtagccatggtcttgaaggaatttattgaccagatgttggcagaaggagcttctcttgatgacatttacatgatcggagtaagtctaggagcccacatatctgggtttgttggagagatgtacgatggatggctggggagaattacaggcctcgaccctgcaggccctttattcaacgggaaacctcaccaagacagattagatcccagtgatgcgcagtttgttgatgtcatccattccgacactgatgcactgggctacaaggagccattaggaaacatagacttctacccaaatggaggattggatcaacctggctgccccaaaacaatattgggaggatttcagtattttaaatgtgaccaccagaggtctgtatacctgtacctgtcttccctgagagagagctgcaccatcactgcgtatccctgtgactcctaccaggattataggaatggcaagtgtgtcagctgcggcacgtcacaaaaagagtcctgtccccttctgggctattatgctgataattggaaagaccatctaagggggaaagatcctccaatgacgaaggcattctttgacacagctgaggagagcccattctgcatgtatcattactttgtggatattataacatggaacaagaatgtaagaagaggggacattaccatcaaattgagagacaaagctggaaacaccacagaatccaaaatcaatcatgaacccaccacatttcagaaatatcaccaagtgagtctacttgcaagatttaatcaagatctggataaagtggctgcaatttccttgatgttctctacaggatctctaataggcccaaggtacaagctcaggattctccgaatgaagttaaggtcccttgcccatccggagaggcctcagctgtgtcggtatgatcttgtcctgatggaaaacgttgaaacagtcttccaacctattctttgcccagagttgcagttgtaactgttgccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgacagctaagagggcggctgctgggactagatagtggatgaagaaagaaggacgaggaagccgtggggcagcctcttcacatggggacaggggatggagcatgaggcaagggaaggaaaagcagagcttatttttcacctaaggtggagaaggatcactttacaggcaacgctcattttaagcaacccttaagaaatgtttatgtttctttattaccaatgtaatctatgattattgaaggaaatttagaaaatgcgtagatacaaaattaaaaaaaaatactgtccacgatcctattagaggtaattaatgttagccttttggaacaaggctgtcacctattttgccaacacgtgaattcaaaacatgaaccggtttgcttttggagaatctgaagactccagtttgaggaatcctttgcttccctggaggtagatgctgtctgcaaatctagaatgacagcaggagtccagtcaagaggtcctgtcaggccaaggccagaaagaagggaggacaatccctggggccagatgcccagtgtgaggggaggcatgatctgtcccatggctgtggccactgcaggaaggtctgtgaaaaggaggtgacaggcccagtcacctcctcttcacccaagtgattgctccttcaactgctatctgtgaaaatagcctttgttatgaagaaattgactctctctctctttttttttttttggagttgcctaggctggagtgcaatggtacgatctcagctcactgcaacctccacctcccaggttcaattgattctcctgcctcagcctcctgagtagctgggattacaggcatgtgccaccacacccggctaatttttgtatttttattagagacagggtttcaccacgttagccaggctcgtctcgaactcctgtcctcaggtgactacccgtctcggcctcccaaagtgctgggattacaggcatgagccaccacacccggccaaaaatggattctctatgtcataaattaaagaaatctataaatgtattcctgtgtggcacatcttcttacagatttacatttgcagcaaatacagagtctgttttatttaagtgagggatgactgaactctgagtggaacaagctcttggacatgttaccatccttcctcctccttctcacatttcctcagcaattgtggatagagagatcagtgtgctgtaggccctggttttttttttttttttttttttttttttttagatggagtctccttctgttacccaggctggagtgcagtggcacgatcttggctcactgcaacctctgcctcccgggttcaagcaattctctgcctcagcctcccaagtagctgggattacaggcgcccccaccatgcctggctaatttttgtatttttagtagagacctggtttcaccatcttggccttgaactcctgaccttgtgatccactggccttggcctctcaaagttctgggattacaggtgtgagccatcgtacccggcagccctggtttcttcttagttttattggtctgtgttttgatcagcacagtcacttttttgttctctttcctggtaagcagggagtcaaaacaatagcaagaaaatgccagaaatagaatttctactactttgtaaactctaggctcgtgggtctcctagctctcagtacctggctcactgtaggatgggtagatgggtgaatgaatggataaagaaaggaagtttgttcaccggagaggagatgaatttcagtaagtttcatgtaacagtgatcaggagaaataaaggcagttataactgtg

SEQ ID NO: 149437 - DNA, 521 bp, Homo sapiens
  Payload ID: 9504
  Gene Symbol: LIPH
  Gene Name: lipase, member H
  ENST ID: ENST00000435679
  CDS Start-End: 1-221
agagcccattctgcatgtatcattactttgtggatattataacatggaacaagaatgtaagaagaggggacattaccatcaaattgagagacaaagctggaaacaccacagaatccaaaatcaatcagatctctaataggcccaaggtacaagctcaggattctccgaatgaagttaaggtcccttgcccatccggagaggcctcagctgtgtcggtatgatcttgtcctgatggaaaacgttgaaacagtcttccaacctattctttgcccagagttgcagttgtaactgttgccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcag

SEQ ID NO: 149438 - DNA, 2065 bp, Homo sapiens
  Payload ID: 9504
  Gene Symbol: LIPH
  Gene Name: lipase, member H
  ENST ID: ENST00000424591
  CDS Start-End: 88-1341
tgagcaaaatcccacagtggaaactcttaagcctctgcgaagtaaatcattcttgtgaatgtgacacacgatctctccagtttccatatgttgagattctacttattcatcagtttgttgtgcttgtcaagatcagacgcagaagaaacatgtccttcattcaccaggctgagctttcacagtgcagtggttggtacgggactaaatgtgaggctgatgctctacacaaggaaaaacctgacctgcgcacaaaccatcaactcctcagcttttgggaacttgaatgtgaccaagaaaaccaccttcattgtccatggattcaggccaacaggctcccctcctgtttggatggatgacttagtaaagggtttgctctctgttgaagacatgaacgtagttgttgttgattggaatcgaggagctacaactttaatatatacccatgcctctagtaagaccagaaaagtagccatggtcttgaaggaatttattgaccagatgttggcagaaggagcttctcttgatgacatttacatgatcggagtaagtctaggagcccacatatctgggtttgttggagagatgtacgatggatggctggggagaattacagcactgggctacaaggagccattaggaaacatagacttctacccaaatggaggattggatcaacctggctgccccaaaacaatattgggaggatttcagtattttaaatgtgaccaccagaggtctgtatacctgtacctgtcttccctgagagagagctgcaccatcactgcgtatccctgtgactcctaccaggattataggaatggcaagtgtgtcagctgcggcacgtcacaaaaagagtcctgtccccttctgggctattatgctgataattggaaagaccatctaagggggaaagatcctccaatgacgaaggcattctttgacacagctgaggagagcccattctgcatgtatcattactttgtggatattataacatggaacaagaatgtaagaagaggggacattaccatcaaattgagagacaaagctggaaacaccacagaatccaaaatcaatcatgaacccaccacatttcagaaatatcaccaagtgagtctacttgcaagatttaatcaagatctggataaagtggctgcaatttccttgatgttctctacaggatctctaataggcccaaggtacaagctcaggattctccgaatgaagttaaggtcccttgcccatccggagaggcctcagctgtgtcggtatgatcttgtcctgatggaaaacgttgaaacagtcttccaacctattctttgcccagagttgcagttgtaactgttgccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgaca

SEQ ID NO: 149439 - DNA, 256 bp, Homo sapiens
  Payload ID: 9504
  Gene Symbol: LIPH
  Gene Name: lipase, member H
  ENST ID: ENST00000452897
  CDS Start-End: 1-256
atgacatttacatgatcggagtaagtctaggagcccacatatctgggtttgttggagagatgtacgatggatggctggggagaattacaggatttcagtattttaaatgtgaccaccagaggtctgtatacctgtacctgtcttccctgagagagagctgcaccatcactgcgtatccctgtgactcctaccaggattataggaatggcaagtgtgtcagctgcggcacgtcacaaaaagagtcctgtccccttct

SEQ ID NO: 149440 - DNA, 556 bp, Homo sapiens
  Payload ID: 9504
  Gene Symbol: LIPH
  Gene Name: lipase, member H
  ENST ID: ENST00000429510
  CDS Start-End: 40-183
attcttgtgaatgtgacacacgatctctccagtttccatatgttgagattctacttattcatcagtttgttgtgcttgtcaagatcagatgcctctttggatatgaatgaggagtctcctctctttgaagagggttttctccagtcagaaatatgggaaataaaattaattcctccaaaatgagacgcagaagaaacatgtccttcattcaccaggctgagctttcacagtgcagtggttggtacgggactaaatgtgaggctgatgctctacacaaggaaaaacctgacctgcgcacaaaccatcaactcctcagcttttgggaacttgaatgtgaccaagaaaaccaccttcattgtccatggattcaggccaacaggctcccctcctgtttggatggatgacttagtaaagggtttgctctctgttgaagacatgaacgtagttgttgttgattggaatcgaggagctacaactttaatatatacccatgcctctagtaagaccagaaaagtagccatggtcttgaaggaatttattgaccagatgttggcag

SEQ ID NO: 149441 - DNA, 1652 bp, Homo sapiens
  Payload ID: 9505
  Gene Symbol: LIPI
  Gene Name: lipase, member I
  Uniprot ID: Q6XZB0
  ENST ID: ENST00000344577
  CDS Start-End: 27-1472
agtgaacttctgatagggtcttatttatgttgctcaaatgtttacataataacttgtgccaaaaatatagtgctcatgcttttcagttctcacccagaaatgtcctgtggcttctagttgtgtgcctgagatcagataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggtttaggcattcaagagcccttgggacatatagatttttatccaaatggaggaaataaacaacctggctgtcctaaatcaattttctcaggaattcaattcattaaatgcaaccaccagagagcagttcacttgttcatggcatctttagaaacaaactgcaattttatttcatttccttgtcgttcatacaaagattacaagactagcttatgtgtggactgtgactgttttaaggaaaaatcatgtcctcggctgggttatcaagccaagctatttaaaggtgttttaaaagaaaggatggaaggaagacctcttaggaccactgtgtttttggatacaagtggtacatatccattctgtacctattattttgttctcagtataattgttccagataaaactatgatggatggctcgttttcatttaaattattaaatcagcttggaatgattgaagagccaaggctttatgaaaagaacaaaccattttataaacttcaagaagtcaagattcttgctcaattttataatgactttgtaaatatttcaagcattggtttgacatatttccagagctcaaatctgcagtgttccacatgcacatacaagatccagagtctcatgttaaaatcacttacatacccagaaagaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattcaagtatttctatttcttggaaaaaattttaagaatcaaaaataaagaaaataaaaaatgcatacagttaaacattccaaa

SEQ ID NO: 149442 - DNA, 421 bp, Homo sapiens
  Payload ID: 9505
  Gene Symbol: LIPI
  Gene Name: lipase, member I
  ENST ID: ENST00000400211
  CDS Start-End: 1-421
ttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggaattcaattcattaaatgcaaccaccagagagcagttcacttgttcatggcatctttagaaacaaactgcaattttatttcatttccttgtcgttcatacaaagattacaagactagcttatgtgtggactgtgactgt

SEQ ID NO: 149443 - DNA, 1529 bp, Homo sapiens
  Payload ID: 9505
  Gene Symbol: LIPI
  Gene Name: lipase, member I
  Uniprot ID: Q6XZB0
  ENST ID: ENST00000536861
  CDS Start-End: 74-1429
cctttttggtgaattgagtgctgtttttgcttttctcagattccaaatgagagtatacatttttctttgtttgatgtgctgggtgagatctgataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggtttaggcattcaagagcccttgggacatatagatttttatccaaatggaggaaataaacaacctggctgtcctaaatcaattttctcaggaattcaattcattaaatgcaaccaccagagagcagttcacttgttcatggcatctttagaaacaaactgcaattttatttcatttccttgtcgttcatacaaagattacaagactagcttatgtgtggactgtgactgttttaaggaaaaatcatgtcctcggctgggttatcaagccaagctatttaaaggtgttttaaaagaaaggatggaaggaagacctcttaggaccactgtgtttttggatacaagtggtacatatccattctgtacctattattttgttctcagtataattgttccagataaaactatgatggatggctcgttttcatttaaattattaaatcagcttggaatgattgaagagccaaggctttatgaaaagaacaaaccattttataaacttcaagaagtcaagattcttgctcaattttataatgactttgtaaatatttcaagcattggtttgacatatttccagagctcaaatctgcagtgttccacatgcacatacaagatccagagtctcatgttaaaatcacttacatacccagaaagaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattc

SEQ ID NO: 149444 - DNA, 1439 bp, Homo sapiens
  Payload ID: 9505
  Gene Symbol: LIPI
  Gene Name: lipase, member I
  ENST ID: ENST00000614229
  CDS Start-End: 74-1339
cctttttggtgaattgagtgctgtttttgcttttctcagattccaaatgagagtatacatttttctttgtttgatgtgctgggtgagatctgataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatggaattcaattcattaaatgcaaccaccagagagcagttcacttgttcatggcatctttagaaacaaactgcaattttatttcatttccttgtcgttcatacaaagattacaagactagcttatgtgtggactgtgactgttttaaggaaaaatcatgtcctcggctgggttatcaagccaagctatttaaaggtgttttaaaagaaaggatggaaggaagacctcttaggaccactgtgtttttggatacaagtggtacatatccattctgtacctattattttgttctcagtataattgttccagataaaactatgatggatggctcgttttcatttaaattattaaatcagcttggaatgattgaagagccaaggctttatgaaaagaacaaaccattttataaacttcaagaagtcaagattcttgctcaattttataatgactttgtaaatatttcaagcattggtttgacatatttccagagctcaaatctgcagtgttccacatgcacatacaagatccagagtctcatgttaaaatcacttacatacccagaaagaccaccactttgcaggtataatattgtacttaaagacagagaggaagtgtttcttaatccaaacacatgtacaccaaagaacacataagatgccttcttccatcaaatgcacttgcttgtgaattaatggacttgtaaatgaaacaatgcaatcagtcttttataatgcactgttcaatttgagattc

SEQ ID NO: 149445 - DNA, 2907 bp, Homo sapiens
  Payload ID: 9506
  Gene Symbol: LDAH
  Gene Name: lipid droplet associated hydrolase
  Uniprot ID: Q9H6V9
  ENST ID: ENST00000237822
  CDS Start-End: 81-1058
acctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttc

SEQ ID NO: 149446 - DNA, 2045 bp, Homo sapiens
  Payload ID: 9506
  Gene Symbol: LDAH
  Gene Name: lipid droplet associated hydrolase
  ENST ID: ENST00000381090
  CDS Start-End: 81-1193
acctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaataggaaatccctcatggcattatcattccctaaggacaatgagatgtccctccgctcaaatcctaaagccccctgatgaaagatttggctctgatttgctgccaacttattggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattat

SEQ ID NO: 149447 - DNA, 1895 bp, Homo sapiens
  Payload ID: 9506
  Gene Symbol: LDAH
  Gene Name: lipid droplet associated hydrolase
  ENST ID: ENST00000403006
  CDS Start-End: 305-1027
ggcacttccggtctcgtgccgccttcccaggaccctcagggagagcgggcagccttccaggtggacaggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaataggaaatccctcatggcattatcattccctaaggacaatgagatgtccctccgctcaaatcctaaagccccctgatgaaagatttggctctgatttgctgccaacttattggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccacca

SEQ ID NO: 149448 - DNA, 493 bp, Homo sapiens
  Payload ID: 9506
  Gene Symbol: LDAH
  Gene Name: lipid droplet associated hydrolase
  ENST ID: ENST00000402479
  CDS Start-End: 56-493
gtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtgagcgtaaaagtctgggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaata

SEQ ID NO: 149449 - DNA, 3837 bp, Homo sapiens
  Payload ID: 9506
  Gene Symbol: LDAH
  Gene Name: lipid droplet associated hydrolase
  ENST ID: ENST00000435420
  CDS Start-End: 97-948
gcggtactgtgacgtcacctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtgagcgtaaaagtctggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgca

SEQ ID NO: 149450 - DNA, 548 bp, Homo sapiens
  Payload ID: 9506
  Gene Symbol: LDAH
  Gene Name: lipid droplet associated hydrolase
  ENST ID: ENST00000432947
  CDS Start-End: 158-548
acttccggtctcgtgccgccttcccaggaccctcagggagagcgggcagccttccaggtggacagattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttat

SEQ ID NO: 149451 - DNA, 3728 bp, Homo sapiens
  Payload ID: 9506
  Gene Symbol: LDAH
  Gene Name: lipid droplet associated hydrolase
  ENST ID: ENST00000440866
  CDS Start-End: 97-597
gcggtactgtgacgtcacctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgca

SEQ ID NO: 149452 - DNA, 566 bp, Homo sapiens
  Payload ID: 9506
  Gene Symbol: LDAH
  Gene Name: lipid droplet associated hydrolase
  ENST ID: ENST00000412261
  CDS Start-End: 89-566
gtgacgtcacctgaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctgattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtcct

SEQ ID NO: 149453 - DNA, 826 bp, Homo sapiens
  Payload ID: 9506
  Gene Symbol: LDAH
  Gene Name: lipid droplet associated hydrolase
  ENST ID: ENST00000419825
  CDS Start-End: 77-547
gaggggggcacttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagagggtggcattcttgctgtcctctcgtggtggacacaggaggcaagccctcttgggactctcgcgggctctaccctcatgaccccatctgatcctaattacttcccaaagacccctctccacctcttaatagcatttgggcatagggtttcacctatggatttgggggccatataagcattcagaccattacagctggttttcacaattgaataaaatttggatttagggcatggaggtgggtgcagaggtacaacagacagaaagagtagcacagaagggagcaagatttaatagcgatgttactgctaagcagggccagtttgagagggactttgagagctggagagagagccaggactccatgctggaaggtttctaaatggaagaagtaataccatggagatgcaaactacctcctttaaatctgtgagaattctagcatgttcactgttc

SEQ ID NO: 149454 - DNA, 3807 bp, Homo sapiens
  Payload ID: 9506
  Gene Symbol: LDAH
  Gene Name: lipid droplet associated hydrolase
  Uniprot ID: Q9H6V9
  ENST ID: ENST00000541941
  CDS Start-End: 331-918
gcggtactgtgacgtcacctgaggggggcacttccggtctcgtgccgccttcccaggaccctcagggagagcgggcagccttccaggtggacaggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgca

SEQ ID NO: 149455 - DNA, 3663 bp, Homo sapiens
  Payload ID: 9506
  Gene Symbol: LDAH
  Gene Name: lipid droplet associated hydrolase
  Uniprot ID: Q9H6V9
  ENST ID: ENST00000619656
  CDS Start-End: 187-774
gcggtactgtgacgtcacctgaggggggcacttccggtctcgtgccgccttcccaggaccctcagggagagcgggcagccttccaggtggacagattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaatttttgaaataaatgttttaccagcatttctgacctggtctggcctgatctctgtgttgggcaagagagggtacaatttgagcagttctcctgagttagactcggctcaaagtctctcttttaaagtgaaaagccacctttctcattgcttttttcataggtggaagaatcagatttcaagagactgaagttcattctgtttcattagggattagactaaaatggacaaacagtggaagaaatccattttccagaagcagctctgcctgtatgtcccagtcaaccacatggatggtctttgtgaaagttttaacttcctgcagagttaccgagtgctcagcgattgagctttgaccacacccgtgtttgttcctagtctgttcccagccataagcatctccacaagccctctgtggcttgtgtggcctgatgtccatggccaccaagggcctctcaccatacgcttctccactcaacctttggagagacacggaccaccaaaggcttgatttttcttcatcctacattatattcaaaacaaacaggctgggtgccgtagctcacacctgtgatcccagcaccttgggaggatgagctgggaagatcgtttgaggctaggagtttgagaccagcccgtgcaaaaaacgagacctcgtgtctaaaataatttttaaaaaagagcaaaaaaaaaaagcaatttcagattaaaggagactgaagagacatgacaattggacacaacatctgattctgaattggatgtttttgttataaaagacattgttgagacaatttgcacaacttgaatgaggtctgaagattagctgggagtaagatgccactgttaattttctgatttcagtggttgtactgggaagaagtaagagagtgtccttgtttgtactggagacactgaggtatctgggggtgaggggcatcatgtctgtttactgtcagatggttgaggggaaaataatgttctttgtacttgcagattttttggaagtttgagatgttttagaatttgtaaaaataattatttttaaaaccccaccatgctatctcctgca

SEQ ID NO: 149456 - DNA, 1179 bp, Homo sapiens
  Payload ID: 9506
  Gene Symbol: LDAH
  Gene Name: lipid droplet associated hydrolase
  Uniprot ID: Q9H6V9
  ENST ID: ENST00000626491
  CDS Start-End: 68-901
acttccggtctcgtgccgccttcccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctgattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatg

SEQ ID NO: 149457 - DNA, 5384 bp, Homo sapiens
  Payload ID: 9507
  Gene Symbol: LPIN1
  Gene Name: lipin 1
  Uniprot ID: Q14693
  ENST ID: ENST00000256720
  CDS Start-End: 94-2766
ccgcccccgaaggcgagctgcgctgacagccggcggcgggctgggtgtttgcaatacaaaggcggccacgcgcggcgccgctcggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctgaaaa

SEQ ID NO: 149458 - DNA, 5690 bp, Homo sapiens
  Payload ID: 9507
  Gene Symbol: LPIN1
  Gene Name: lipin 1
  Uniprot ID: Q14693
  ENST ID: ENST00000396097
  CDS Start-End: 278-3076
gcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtagcctggtagattgcaaaaggactgcccctcatcttgcagttgcggccgagggaggtctgtctagttcttgccctccacagtcttccctgttccatccttcggaaagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctg

SEQ ID NO: 149459 - DNA, 1761 bp, Homo sapiens
  Payload ID: 9507
  Gene Symbol: LPIN1
  Gene Name: lipin 1
  Uniprot ID: Q14693
  ENST ID: ENST00000396098
  CDS Start-End: 363-1742
agcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtagcctggtagattgcaaaaggactgcccctcatcttgcagttgcggccgagggaggtctgtctagttcttgccctccacagtcttccctgttccatccttcggaaagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaagtaaaattcctgttaattcctca

SEQ ID NO: 149460 - DNA, 3228 bp, Homo sapiens
  Payload ID: 9507
  Gene Symbol: LPIN1
  Gene Name: lipin 1
  ENST ID: ENST00000396099
  CDS Start-End: 363-2468
agcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggttcgcatgagcaggggcctttatctgaagttaatggaagctgagccaggtcctgacaatgtgccttctgatggggagatgagactttcctctgaaagctaaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtagcctggtagattgcaaaaggactgcccctcatcttgcagttgcggccgagggaggtctgtctagttcttgccctccacagtcttccctgttccatccttcggaaagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccgga

SEQ ID NO: 149461 - DNA, 477 bp, Homo sapiens
  Payload ID: 9507
  Gene Symbol: LPIN1
  Gene Name: lipin 1
  ENST ID: ENST00000423495
  CDS Start-End: 394-477
gcaatacaaaggcggccacgcgcggcgccgctcgtatttgcaaccacgtggcttcacgagtccgccaaaccatcaggtgaataaacgggagaggagaagagagtctaggactcagccctggagtataagtcagagctggaaaagaagaggctccagagactggacggccactgagaggtgccacgtccctgaagggcctgaggagggttgatggcatgaccccatgaagcccagcaaggagtggagagaggagggctggaggactcccgcctgccatgacccagtccagggataagattggcacgatctcagctcactgcagcctccacctcctgggttcaagtgatcttcccacctcagcctcccaagtagctgggactacaggtgcagaccatgaattacgtggggcagttagccggccaggtgtttgtcaccgtgaaggagctctacaaggggctgaatcccgccacactctca

SEQ ID NO: 149462 - DNA, 3077 bp, Homo sapiens
  Payload ID: 9507
  Gene Symbol: LPIN1
  Gene Name: lipin 1
  Uniprot ID: Q14693
  ENST ID: ENST00000449576
  CDS Start-End: 54-2981
atttctctcctgatgctgggtgaggaggcagacagcaccatacagggcgggccatgggggaacaggacggcattcgcagctccagctgggagacctcgcagggcaagagctccccagactcggcttggtcatggattccaataatgagagaccctgggtggattcgaaatgtatggtcttcaaacattaacgtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtagcctggtagattgcaaaaggactgcccctcatcttgcagttgcggccgagggaggtctgtctagttcttgccctccacagtcttccctgttccatccttcggaaagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcct

SEQ ID NO: 149463 - DNA, 5582 bp, Homo sapiens
  Payload ID: 9507
  Gene Symbol: LPIN1
  Gene Name: lipin 1
  Uniprot ID: Q14693
  ENST ID: ENST00000425416
  CDS Start-End: 278-2968
gcgcagggcatggatgaaagcaagctggagagggagagaggatgggaggcgaggaggcagcctgagggaaggaacaggagggaagagagatgaagggcaagaccggggccagccatgcctgtcctaacagcagccacccagcagtggcccagcctgctgagaactagaaaatcagaagaaaaaggagaatccaccaggagacccaggtaactctgaagcgtgagctgccagaattcaaggccacctgcttaacagaagacaactagaaacctcatccatgagcagagtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctg

SEQ ID NO: 149464 - DNA, 599 bp, Homo sapiens
  Payload ID: 9507
  Gene Symbol: LPIN1
  Gene Name: lipin 1
  ENST ID: ENST00000441684
  CDS Start-End: 312-599
gtttgcaatacaaaggcggccacgcgcggcgccgctcgtatttgcaaccacgtggcttcacgagtccgccaaaccatcaggtgaataaacgggagaggagaagagagtctaggactcagccctggagtataagtcagagctggaaaagaagaggctccagagactggacggccactgagaggtgccacgtccctgaagggcctgaggagggttgatggcatgaccccatgaagcccagcaaggagtggagagaggagggctggaggactcccgcctgccatgacccagtccagggataagatgtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcag

SEQ ID NO: 149465 - DNA, 583 bp, Homo sapiens
  Payload ID: 9507
  Gene Symbol: LPIN1
  Gene Name: lipin 1
  ENST ID: ENST00000454151
  CDS Start-End: 1-583
atcgatgaccccaatctcgtggtaaagattgggagtaaatattataactggacaacagcagcacccctcctcctggcaatgcaggccttccagaaacctttgccaaagtcttcatgcttaagttaccttcatgtaattttggacgccattaggttttgcttctctaaaatttttaacgcacaaatagccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgt

SEQ ID NO: 149466 - DNA, 6229 bp, Homo sapiens
  Payload ID: 9508
  Gene Symbol: LPIN2
  Gene Name: lipin 2
  Uniprot ID: Q92539
  ENST ID: ENST00000261596
  CDS Start-End: 240-2930
gagaagaagtggcaggtgatgctgaagcgggggagaagcggcagagccggccacacagtgcaggggatggagacaggtgctgggctggtcctcctgcagcatcctcagttgttggagggcagtcatcctcaggccgtacccagccagagaagaaaaagaacagtgtgaagccacgtgtgatagccgtccaacatcggctcttccctccaattacattgtagttgattgtgtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaatttcgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaa

SEQ ID NO: 149467 - DNA, 936 bp, Homo sapiens
  Payload ID: 9508
  Gene Symbol: LPIN2
  Gene Name: lipin 2
  ENST ID: ENST00000584294
  CDS Start-End: 239-936
agctgccggctcggccgccgcagccgcggcgtcccattcatgagggccgcccgactcagctgcggcccaggcggcttccaaggcagcggcggctgcgggcgctccgaccccgcgcgcgcccccgaccggccccgccccctcggcttccctccccggcgggtcctagccgtcgcagtccagccgccgcctgccctcagccgcccgctggccgggagcggagcccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagac

SEQ ID NO: 149468 - DNA, 491 bp, Homo sapiens
  Payload ID: 9508
  Gene Symbol: LPIN2
  Gene Name: lipin 2
  ENST ID: ENST00000584915
  CDS Start-End: 105-491
actgtgtctgcaagcagtttgtactcagtttgtcaagagagcagctttctgttttgattatataccttcatctctgaaaaaagacatgctagttaaatttcaagatgttttacttagaagatgacaaggaagatgaggtggtttgtaaaggctcattaagtaaaactcaagatgtttaccatgacaagtcccctcctggtatcttgtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagact

SEQ ID NO: 149469 - DNA, 4363 bp, Homo sapiens
  Payload ID: 9509
  Gene Symbol: LPIN3
  Gene Name: lipin 3
  Uniprot ID: Q9BQK8
  ENST ID: ENST00000373257
  CDS Start-End: 92-2647
cgaagacactcacctgtggagcctgtgcacgtaggtagaggcggcggctctgagtccaggagctccagtgggcagctccccagcaccagccatgaactacgtggggcagctggcggagacggtgtttgggacggtgaaggagctgtaccggggcctgaacccagccacactgagcggcggcattgacgtgctggtggtgaagcaggtggacggctcgttccggtgctcacccttccacgtgcgttttggcaagctgggcgtcctgcggtcgcgggagaaggtggtagacattgagctcaatggggagcctgtggacttgcacatgaagcttggggacagcggggaggccttctttgttcaggagctggagagcgatgatgaacatgtgcctcccggcctgtgcacctcacccatcccttgggggggtctgtctggcttcccctcggactcccagctgggcactgccagtgagcctgagggcctcgtcatggcaggcacggcctccactgggcggaggaagaggcgtcgcaggaggaaacccaagcagaaagaggatgcagtggcaactgattctagtccagaggaactggaggcaggcgctgagagtgagctatccctgccggaaaagctgaggccagagcccccaggtgtccagttggaagagaagtcttcactgcagcccaaagacatctacccctactcggatggcgagtggcccccccaggccagcctctcagcaggtgagctaacatcccctaagagcgactcggagctggaggtgcggaccccggagcccagtcccctaagagccgagtcccacatgcagtgggcctgggggaggctgcctaaggtggccagagctgagcggcccgagtcctcagtggtccttgaaggcagagctggggcaacctctcctcctcggggaggacccagcactccctctacctctgtggctggcggcgtggaccctttgggactcccaatccagcaaacagaggctggtgccgaccttcagcctgacacagaggatcccactctagtgggtccccctctccacaccccagagacagaggaaagcaagactcagagctctggggacatgggcctccctcctgcctccaagtcatggagctgggccactctggaggttccagttcccaccgggcagccagagagggtctccagggggaaaggctccccaaagagaagccagcacctgggccccagtgacatctacctggatgacttgccctccctggactctgagaatgcagcgctttacttcccccaaagtgactctgggctgggggccagaagatggagtgaacccagcagtcagaagtccctgagggaccccaaccctgaacatgaacctgaacccactctggacacagtggatacaatagcactgtccctctgtggtggactggctgacagccgggacatctccctagagaaattcaaccagcacagcgtctcttaccaggacctcaccaaaaaccccggacttttggatgacccaaacctagtggtgaaaatcaatggaaagcattataactgggctgtggctgcccccatgatcctctccctgcaagccttccagaaaaacttgcccaagagcaccatggacaagctggagagggagaagatgccccggaagggtgggcgatggtggttttcctggcgacgcagggacttcctggccgaggagcgcagtgcccagaaggagaagactgcagccaaggagcagcagggggagaagacagaagtcctgagcagtgatgacgatgccccagacagccctgtgatcctggagatcccctccttgccaccctccactccaccctccactcctacctacaagaagtccctccgcctctcctccgatcagatccggcgcctgaacctgcaagaaggtgccaatgatgtggtcttcagcgtgaccactcagtaccagggcacctgccgctgcaaggccaccatctacctgtggaaatgggacgacaaggtggtcatctctgacatcgacggcaccatcaccaagtcagatgctctgggccatatcctgccccagctggggaaagactggacacaccagggcatcaccagtctctatcacaaaatccaactaaatgggtacaagttcctgtactgctcggcgcgggccattggcatggcggacctcaccaaggggtacctgcagtgggtgagcgaggggggctgtagcctccccaagggccccatccttctgtctcccagcagcctcttctctgccctccacagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaagaggacagtgtgggcaccagagggccctggaaacatcttaggggaaggaaaggaaaaggataaatttggagtggggggtctctaaacagattgcctggattccgttctttcctggggttctacagctgcctaagccctcaccttgggggaggatcaaagggaataaagagaactcttggctga

SEQ ID NO: 149470 - DNA, 808 bp, Homo sapiens
  Payload ID: 9509
  Gene Symbol: LPIN3
  Gene Name: lipin 3
  ENST ID: ENST00000445975
  CDS Start-End: 1-808
tggtgaaaatcaatggaaagcattataactgggctgtggctgcccccatgatcctctccctgcaagccttccagaaaaacttgcccaagcgcagtgcccagaaggagaagactgcagccaaggagcagcagggggagaagacagaagtcctgagcagtgatgacgatgccccagacagccctgtgatcctggagatcccctccttgccaccctccactccaccctccactcctacctacaagaagtccctccgcctctcctccgatcagatccggcgcctgaacctgcaagaaggtgccaatgatgtggtcttcagcgtgaccactcagtaccagggcacctgccgctgcaaggccaccatctacctgtggaaatgggacgacaaggtggtcatctctgacatcgacggcaccatcaccaagtcagatgctctgggccatatcctgccccagctggggaaagactggacacaccagggcatcaccagtctctatcacaaaatccaactaaatgggtacaagttcctgtactgctcggcgcgggccattggcatggcggacctcaccaaggggtacctgcagtgggtgagcgaggggggctgtagcctccccaagggccccatccttctgtctcccagcagcctcttctctgccctccacagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcc

SEQ ID NO: 149471 - DNA, 4132 bp, Homo sapiens
  Payload ID: 9509
  Gene Symbol: LPIN3
  Gene Name: lipin 3
  Uniprot ID: Q9BQK8
  ENST ID: ENST00000632009
  CDS Start-End: 40-2598
agtccaggagctccagtgggcagctccccagcaccagccatgaactacgtggggcagctggcggagacggtgtttgggacggtgaaggagctgtaccggggcctgaacccagccacactgagcggcggcattgacgtgctggtggtgaagcaggtggacggctcgttccggtgctcacccttccacgtgcgttttggcaagctgggcgtcctgcggtcgcgggagaaggtggtagacattgagctcaatggggagcctgtggacttgcacatgaagcttggggacagcggggaggccttctttgttcaggagctggagagcgatgatgaacatgtgcctcccggcctgtgcacctcacccatcccttgggggggtctgtctggcttcccctcggactcccagctgggcactgccagtgagcctgagggcctcgtcatggcaggcacggcctccactgggcggaggaagaggcgtcgcaggaggaaacccaagcagaaagaggatgcagtggcaactgattctagtccagaggaactggaggcaggcgctgagagtgagctatccctgccggaaaagctgaggccagagcccccaggcagtgtccagttggaagagaagtcttcactgcagcccaaagacatctacccctactcggatggcgagtggcccccccaggccagcctctcagcaggtgagctaacatcccctaagagcgactcggagctggaggtgcggaccccggagcccagtcccctaagagccgagtcccacatgcagtgggcctgggggaggctgcctaaggtggccagagctgagcggcccgagtcctcagtggtccttgaaggcagagctggggcaacctctcctcctcggggaggacccagcactccctctacctctgtggctggcggcgtggaccctttgggactcccaatccagcaaacagaggctggtgccgaccttcagcctgacacagaggatcccactctagtgggtccccctctccacaccccagagacagaggaaagcaagactcagagctctggggacatgggcctccctcctgcctccaagtcatggagctgggccactctggaggttccagttcccaccgggcagccagagagggtctccagggggaaaggctccccaaagagaagccagcacctgggccccagtgacatctacctggatgacttgccctccctggactctgagaatgcagcgctttacttcccccaaagtgactctgggctgggggccagaagatggagtgaacccagcagtcagaagtccctgagggaccccaaccctgaacatgaacctgaacccactctggacacagtggatacaatagcactgtccctctgtggtggactggctgacagccgggacatctccctagagaaattcaaccagcacagcgtctcttaccaggacctcaccaaaaaccccggacttttggatgacccaaacctagtggtgaaaatcaatggaaagcattataactgggctgtggctgcccccatgatcctctccctgcaagccttccagaaaaacttgcccaagagcaccatggacaagctggagagggagaagatgccccggaagggtgggcgatggtggttttcctggcgacgcagggacttcctggccgaggagcgcagtgcccagaaggagaagactgcagccaaggagcagcagggggagaagacagaagtcctgagcagtgatgacgatgccccagacagccctgtgatcctggagatcccctccttgccaccctccactccaccctccactcctacctacaagaagtccctccgcctctcctccgatcagatccggcgcctgaacctgcaagaaggtgccaatgatgtggtcttcagcgtgaccactcagtaccagggcacctgccgctgcaaggccaccatctacctgtggaaatgggacgacaaggtggtcatctctgacatcgacggcaccatcaccaagtcagatgctctgggccatatcctgccccagctggggaaagactggacacaccagggcatcaccagtctctatcacaaaatccaactaaatgggtacaagttcctgtactgctcggcgcgggccattggcatggcggacctcaccaaggggtacctgcagtgggtgagcgaggggggctgtagcctccccaagggccccatccttctgtctcccagcagcctcttctctgccctccacagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaag

SEQ ID NO: 149472 - DNA, 776 bp, Homo sapiens
  Payload ID: 9510
  Gene Symbol: LCN1
  Gene Name: lipocalin 1
  Uniprot ID: P31025
  ENST ID: ENST00000263598
  CDS Start-End: 61-591
acagcctctcccagccccagcaagcgacctgtcaggcggccgtggactcagactccggagatgaagcccctgctcctggccgtcagccttggcctcattgctgccctgcaggcccaccacctcctggcctcagacgaggagattcaggatgtgtcagggacgtggtatctgaaggccatgacggtggacagggagttccctgagatgaatctggaatcggtgacacccatgaccctcacgaccctggaagggggcaacctggaagccaaggtcaccatgctgataagtggccggtgccaggaggtgaaggccgtcctggagaaaactgacgagccgggaaaatacacggccgacgggggcaagcacgtggcatacatcatcaggtcgcacgtgaaggaccactacatcttttactgtgagggcgagctgcacgggaagccggtccgaggggtgaagctcgtgggcagagaccccaagaacaacctggaagccttggaggactttgagaaagccgcaggagcccgcggactcagcacggagagcatcctcatccccaggcagagcgaaacctgctctccagggagcgattagggggacaccttggctcctcagcagcccaaggacggcaccatccagcacctccgtcattcacagggacatggaaaaagctccccacccctgcagaacgcggctggctgcaccccttcctaccaccccccgccttccccctgccctgcgccccctctcctggttctccataaagagcttcagcagtt

SEQ ID NO: 149473 - DNA, 764 bp, Homo sapiens
  Payload ID: 9510
  Gene Symbol: LCN1
  Gene Name: lipocalin 1
  Uniprot ID: P31025
  ENST ID: ENST00000371781
  CDS Start-End: 44-574
cagcaagcgacctgtcaggcggccgtggactcagactccggagatgaagcccctgctcctggccgtcagccttggcctcattgctgccctgcaggcccaccacctcctggcctcagacgaggagattcaggatgtgtcagggacgtggtatctgaaggccatgacggtggacagggagttccctgagatgaatctggaatcggtgacacccatgaccctcacgaccctggaagggggcaacctggaagccaaggtcaccatgctgataagtggccggtgccaggaggtgaaggccgtcctggagaaaactgacgagccgggaaaatacacggccgacgggggcaagcacgtggcatacatcatcaggtcgcacgtgaaggaccactacatcttttactgtgagggcgagctgcacgggaagccggtccgaggggtgaagctcgtgggcagagaccccaagaacaacctggaagccttggaggactttgagaaagccgcaggagcccgcggactcagcacggagagcatcctcatccccaggcagagcgaaacctgctctccagggagcgattaggggcaggggacaccttggctcctcagcagcccaaggacggcaccatccagcacctccgtcattcacagggacatggaaaaagctccccacccctgcagaacgcggctggctgcaccccttcctaccaccccccgccttccccctgccctgcgccccctctcctggttctccataaagagcttcagcagtt

SEQ ID NO: 149474 - DNA, 723 bp, Homo sapiens
  Payload ID: 9511
  Gene Symbol: LCN10
  Gene Name: lipocalin 10
  Uniprot ID: Q6JVE6
  ENST ID: ENST00000497771
  CDS Start-End: 57-659
ggcggctccagagaggtttaaacactggccttggcggctgagggaggagggtgaagatgaggcaggggctgctggtgctggcgctggtgctggtgctggtgctagtgctggctgcagggtcccaggtgcaggagtggtaccccagggagtcccacgccctcaactggaacaagttttcagggttctggtacattctggccactgccactgatgcccagggattcttgccggccagggacaagaggaagctgggggcgtccgtggtaaaggtgaacaaagtgggccagctccgcgtgctcctcgccttcagacggttgaaggggtgccagtcccaggaggtgatcctgaggaaagacgggaagaagccggtgtttgggaacgcctgtgcatacgcggcgggcccgagggaaggacaggagggagtgaaaggggtgaaggccttccacgtgctgtccactgactacagctacggcttggtctacctccgcctggggcgtgcaacccaaaactacaagaacctgctgctcttccataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttc

SEQ ID NO: 149475 - DNA, 564 bp, Homo sapiens
  Payload ID: 9511
  Gene Symbol: LCN10
  Gene Name: lipocalin 10
  Uniprot ID: Q6JVE6
  ENST ID: ENST00000474369
  CDS Start-End: 1-564
atgaggcaggggctgctggtgctggcgctggtgctggtgctggtgctagtgctggctgcagggtcccaggtgcaggagtggtaccccagggagtcccacgccctcaactggaacaagttttcagggttctggtacattctggccactgccactgatgcccagggattcttgccggccagggacaagaggaagctgggggcgtccgtggtaaaggtgaacaaagtgggccagctccgcgtgctcctcgccttcagacggggtcagggctgtgggcgggcacagccacgccatccgggaaccagcgggcatctctgggcatctctttcagtgaaaggggtgaaggccttccacgtgctgtccactgactacagctacggcttggtctacctccgcctggggcgtgcaacccaaaactacaagaacctgctgctcttccataggcagaatgtttcgagcttccagagtctgaaggaattcatggacgcttgtgacattctggggctctccaaggccgccgtcatcctcccgaaagacgcgtcccgtacacacaccatcctgccatga

SEQ ID NO: 149476 - DNA, 615 bp, Homo sapiens
  Payload ID: 9511
  Gene Symbol: LCN10
  Gene Name: lipocalin 10
  ENST ID: ENST00000527229
  CDS Start-End: 57-551
ggcggctccagagaggtttaaacactggccttggcggctgagggaggagggtgaagatgaggcaggggctgctggtgctggcgctggtgctggtgctggtgctagtgctggctgcagggtcccaggtgcaggagtggtaccccagggagtcccacgccctcaactggaacaagttttcagggttctggtacattctggccactgccactgatgcccagggattcttgccggccagggacaagaggaagctgggggcgtccgtggtaaaggtgaacaaagtgggccagctccgcgtgctcctcgccttcagacggttgaaggggtgccagtcccaggaggtgatcctgaggaaagacgggaagaagccggtgtttgggaacgcctgtgcatacgcggcgggcccgagggaaggacaggagggagataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttc

SEQ ID NO: 149477 - DNA, 570 bp, Homo sapiens
  Payload ID: 9511
  Gene Symbol: LCN10
  Gene Name: lipocalin 10
  ENST ID: ENST00000529013
  CDS Start-End: 1-112
cactgatgcccagggattcttgccggccagggacaagaggaagctgggggcgtccgtggtaaaggtgaacaaagtgggccagctccgcgtgctcctcgccttcagacggtgagtgggcagcgccccccaggcaagggtctccccttccaggaggagggagctgcctcggggctggaaaggagtctgggaggagcctgtctgtctggaagttccacaagaaccgtccccccacttcctccccctaaactcagaggaagccacctgcagcccctgggaccccacatgggtgggtgttgggaggaagctgcctgcagaccttgggaccccacatggtgaaaggggtgaaggccttccacgtgctgtccactgactacagctacggcttggtctacctccgcctggggcgtgcaacccaaaactacaagaacctgctgctcttccataggcagaatgtttcgagcttccagagtctgaaggaattcatggacgcttgtgacattctggggctctccaaggccgccgtcatcctcccgaaagacgcgtcccgtacacacaccatcctgccatgag

SEQ ID NO: 149478 - DNA, 443 bp, Homo sapiens
  Payload ID: 9511
  Gene Symbol: LCN10
  Gene Name: lipocalin 10
  ENST ID: ENST00000532006
  CDS Start-End: 57-284
ggcggctccagagaggtttaaacactggccttggcggctgagggaggagggtgaagatgaggcaggggctgctggtgctggcgctggtgctggtgctggtgctagtgctggctgcagggtcccaggtgcaggagtggtaccccagggagtcccacgccctcaactggaacaagggacaagaggaagctgggggcgtccgtggtaaaggtgaacaaagtgggccagctccgcgtgctcctcgccttcagacgataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttc

SEQ ID NO: 149479 - DNA, 1780 bp, Homo sapiens
  Payload ID: 9511
  Gene Symbol: LCN10
  Gene Name: lipocalin 10
  ENST ID: ENST00000341040
  CDS Start-End: 38-298
aaacactggccttggcggctgagggaggagggtgaagatgaggcaggggctgctggtgctggcgctggtgctggtgctggtgctagtgctggctgcagggtcccaggtgcaggagtggtaccccagggagtcccacgccctcaactggaacaagttttcagggttctggtacattctggccactgccactgatgcccagggattcttgccggccagggacaagaggaagctgggggcgtccgtggtaaaggtgaacaaagtgggccagctccgcgtgctcctcgccttcagacgataggcagaatgtttcgagcttccagagtctgaaggaattcatggacgcttgtgacattctggggctctccaaggccgccgtcatcctcccgaaagacgcgtcccgtacacacaccatcctgccatgagagccagcgtcctctgctcttccctttcgacgcgtggtcctcccagacccgaggagcgttgttccagatgtcaagtggagaccacggcttgttgagaggtgtttggtgactctaggtcattgacagtgtgaaaatcaagtggctcaagggatcctttatgatcacagaaagatgggggaaggaggatacaggctgaccgggtggcgagatgtcagccaggccccttccccactgtcttctggagcacactgcaggctgctgctattccctgtctgctgtgaaacagaccacaggccggcccaacgcagtcctcgccgtgtgccttgcctctgccctccacgccgccgccaccctccgcgttcctttacatcctgcactttctcaggaagccgttcgcatatccacccaacatggaggagcccccatgacgtgccaggcagcgtgctggcccctgcggctgcgttagggaacagaatcggcaaacgcagtcccagagttgatgcctgatcaggagaagccaacttcagcagtgtggtcacctggatactcgagtatagaccctagatcacctggatactcgagtatagaccctagaagtgtatctaggcgcggccagggccccacaacagcaggtctgactcattccatccagggcagcatcagggagagcttcctgggggaagtggcatttgggctgacctgggaagggtggtgggtgttaagtcagtttgggtggggctggaggagcaggggtgcatccccagaacaggatgtgacttctgaaaagacatcagagtagagaaaatggtttctcaaggagattggggacgccagtatcagaatggcggcggggagagccacagaggagcaggagggggcccaccagaccacggcacctcgaaggctgcggtgaaggcttaggtctcactcaaggggtgatgacgggaggttgtctgagatgaaccccccaactgaatgaatggaccttcttctggccaaggggatcccaaagaaaccctgaacccgagtcctcagccatgacggggtaaggggtcagcccctccttctggcccgagaagagatcagagattggttctgggcagtccatggagaatttgctcagctggaccagtacacgcttctcctttcatgaatattcatgactcctcctgaagcttattgaacatctctatttggccatctccttcagcgtaaattcctgtcccctctgtccctcccctccaagtgtctgttccaggcttctggcctgaggctacgcttcctagcctgtcagaagggctgccctgctggctgcaatctcttatgagaaataaagctctcctgtgtgcaaaaaagta

SEQ ID NO: 149480 - DNA, 403 bp, Homo sapiens
  Payload ID: 9512
  Gene Symbol: LCN12
  Gene Name: lipocalin 12
  ENST ID: ENST00000371632
  CDS Start-End: 1-273
acttttgagctaagtgatgatggccgctttgaggtgtggaatgcgatgactcgaggccagcactgtgacacatggtcttatgtgctgataccggcagcccagcctgggcagttcactgtggaccacggtgtggacacacgagcaggctggccgtcctcaggatcagcctgctgggcaggagctggttgctgcctcccgggacgctggaccagttcatctgcctgggcagagctcagggcctctcggatgacaacatcgtcttcccagatgtgactggctggtcaccccaggccagcgtctgttgaaggatgaagcagctcctgtccggcccagccctgcctcacagctgtgcgagctctgccctcctcagctctcaaacctgaataaatgcaccaagcccaga

SEQ ID NO: 149481 - DNA, 579 bp, Homo sapiens
  Payload ID: 9512
  Gene Symbol: LCN12
  Gene Name: lipocalin 12
  Uniprot ID: Q6JVE5
  ENST ID: ENST00000371633
  CDS Start-End: 1-579
atgaggctgctgtgtggcctgtggctgtggctctccttgctgaaagtcctgcaggcccagaccccaacccccctgccactcccgcccccgatgcagagcttccaaggaaaccagttccagggggaatggttcgtcctgggcctggcgggcaacagcttcaggccggagcacagggcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtggagcccggggcggacagagaggagacccgggtggtggacagcgactacacccagttcgccctgatgctgtcccgcagacacacgagcaggctggccgtcctcaggatcagcctgctgggcaggagctggttgctgcctcccgggacgctggaccagttcatctgcctgggcagagctcagggcctctcggatgacaacatcgtcttcccagatgtgactggctggtcaccccaggccagcgtctgttga

SEQ ID NO: 149482 - DNA, 489 bp, Homo sapiens
  Payload ID: 9512
  Gene Symbol: LCN12
  Gene Name: lipocalin 12
  ENST ID: ENST00000471615
  CDS Start-End: 1-309
gcgctgctgaacgctttcaccgcaacttttgagctaagtgatgatggccgctttgaggtgtggaatgcgatgactcgaggccagcactgtgacacatggtcttatgtgctgataccggcagcccagcctgggcagttcactgtggaccacggtgtgggcaggagctggttgctgcctcccgggacgctggaccagttcatctgcctgggcagagctcagggcctctcggatgacaacatcgtcttcccagatgtgactggaggtgccctggacctcagcagcctgccctgggtggcagccccagcctgaccactcagacagccgcggcccccaaggcctgactcttcttgtgggagggcgaggctggtcaccccaggccagcgtctgttgaaggatgaagcagctcctgtccggcccagccctgcctcacagctgtgcgagctctgccctcctcagctctcaaacctgaataaatgcaccaagcccaga

SEQ ID NO: 149483 - DNA, 762 bp, Homo sapiens
  Payload ID: 9513
  Gene Symbol: LCN15
  Gene Name: lipocalin 15
  Uniprot ID: Q6UWW0
  ENST ID: ENST00000316144
  CDS Start-End: 26-580
caggggctggagggcaggggaggggatgatgtcattcctgctcggcgcaatcctgaccctgctctgggcgcccacggctcaggctgaggttctgctgcagcctgacttcaatgctgaaaagttctcaggcctctggtacgtggtctccatggcatctgactgcagggtcttcctgggcaagaaggaccacctgtccatgtccaccagggccatcaggcccacagaggagggcggcctccacgtccacatggagttcccgggggcggacggctgtaaccaggtggatgccgagtacctgaaggtgggctccgagggacacttcagagtcccggccttgggctacctggacgtgcgcatcgtggacacagactacagctccttcgccgtcctttacatctacaaggagctggagggggccctcagcaccatggtgcagctctacagccggacccaggatgtgagtccccaggctctgaagtccttccaggacttctacccgaccctggggctccccaaggacatgatggtcatgctgccccagtcagatgcatgcaaccctgagagcaaggaggcgccctgacacctccggagccccacccccgcccttcccaggtggagccaaagcagcaggcgcctttgcccctggagtcaagacccacagccctcggggaccacctggagtctctccatcctccaccccccgcctgtgggatgccttgtgggacgtctctttctattcaataaacagatgctgcagcctca

SEQ ID NO: 149484 - DNA, 822 bp, Homo sapiens
  Payload ID: 9514
  Gene Symbol: LCN2
  Gene Name: lipocalin 2
  Uniprot ID: P80188
  ENST ID: ENST00000277480
  CDS Start-End: 74-670
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcaggcc

SEQ ID NO: 149485 - DNA, 631 bp, Homo sapiens
  Payload ID: 9514
  Gene Symbol: LCN2
  Gene Name: lipocalin 2
  ENST ID: ENST00000372998
  CDS Start-End: 9-611
ctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttagggagaaggcccagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacagtgagtgtggctg

SEQ ID NO: 149486 - DNA, 848 bp, Homo sapiens
  Payload ID: 9514
  Gene Symbol: LCN2
  Gene Name: lipocalin 2
  Uniprot ID: P80188
  ENST ID: ENST00000373017
  CDS Start-End: 238-834
ggcattcattctttcctttctgtgggtgtggggaggggaccacagggcacataccccaccctgggatccagctgagcaggggggtcagagatgacagctcttccggctcacaggccaccggcccacatacagggcaatcagaagaaagaaacagcacaaggaaggcacagagggagtcgttgtccctgccagaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacagtgagtg

SEQ ID NO: 149487 - DNA, 717 bp, Homo sapiens
  Payload ID: 9515
  Gene Symbol: LCN6
  Gene Name: lipocalin 6
  Uniprot ID: P62502
  ENST ID: ENST00000341206
  CDS Start-End: 46-537
gggactgcacatcctgggcctgcggcgcagtgtagacctgggaggatgggcggcctgctgctggctgcttttctggctttggtctcggtgcccagggcccaggccgtgtggttgggaagactggaccctgagcagcttcttgggccctggtacgtgcttgcggtggcctcccgggaaaagggctttgccatggagaaggacatgaagaacgtcgtgggggtggtggtgaccctcactccagaaaacaacctgcggacgctgtcctctcagcacgggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggacctcacctgtgctcacaagatccttctgtgagtgctgcgtccccagtagggatggcgcccacagggtcctgtgacctcggccagtgtccacccacctcgctcagcggctcccggggcccagcaccagctcagaataaagcgattccacagcaaaccaagg

SEQ ID NO: 149488 - DNA, 1015 bp, Homo sapiens
  Payload ID: 9515
  Gene Symbol: LCN6
  Gene Name: lipocalin 6
  ENST ID: ENST00000476567
  CDS Start-End: 134-370
ctctggcctcactgctggctggcctggcctggactcctgagctccgtctcctctcaccgggccccggggtcttgaccctgagtgggtgacaggccccttcttttccaggctgggagggtgtgaccagagtgtcatggacctgataaagcgaaactccggatgggtgtttgagaatccctcaataggcgtgctggagctctgggtgctggccaccaacttcagagactatgccatcatcttcactcagctggagttcggggacgagcccttcaacaccgtggagctgtacagtctgacggagacagccagccaggaggccatggggctcttcaccaagtggagcaggagcctgggcttcctgtcacagtagcaggcccagctgcagaaggaccgtgagtgtccaccggagcagcctcgggggaggcttggggcaagttctggagcccacagggcgtgatggggtgacagagaccctggggttgattctggcttctgcctgactcagtcgccctgaaggagtcaggcaggctgagggggtcttcacctgcccctgcccaaagtcaggcctgggggtcttgtccccacggcaggcgagtcttgtgggtggggccctggggtgctggggggctcagtcctttttcacagccagtcttgcctccccttctagtcacctgtgctcacaagatccttctggtaagccgccatcctgagcctcaccctgggctctcttgggggaagggggtgggggaggccaccctacgcacagtgggtgggaggaccctctgcccaagcccacggggttcatggctccactgtctctaaggcagctgagggtgtggaggagcctccatggtgggctgggccccctcacactcctcttggttttcagtgagtgctgcgtccccagtagggatggcgcccacagggtcctgtgacctcggccagtgtccacccacctcgctcagcggctcccggggcccagcaccagctcagaataaagcgattccacagcaaa

SEQ ID NO: 149489 - DNA, 867 bp, Homo sapiens
  Payload ID: 9516
  Gene Symbol: LCN8
  Gene Name: lipocalin 8
  Uniprot ID: Q6JVE9
  ENST ID: ENST00000371688
  CDS Start-End: 297-755
atatgccaggagggtggctgggcaggctgctgtctaggccaggctaacccctgcggtgggcgtgggtgtcaccagggccgatggcgcttgtgcagaaacccacgtctctgagctgccagcagccaagctgtcctgatgacattcccgggtgggcgcacaagcctgcactgtccgtatagaatcggcccaggctgtgcagcaggggaacccggagcccggaccccgccacggaggccaggctgccgtgcaccatcctgggtgtcctcgtggtgctccgggcgcaggtggcagcagccatggaggagctggaccggcagaagattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttactcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtcaa

SEQ ID NO: 149490 - DNA, 638 bp, Homo sapiens
  Payload ID: 9516
  Gene Symbol: LCN8
  Gene Name: lipocalin 8
  Uniprot ID: Q6JVE9
  ENST ID: ENST00000612714
  CDS Start-End: 1-528
atgcctggtgcagcagaggccctccccactgtcactgtcactctggtcgctggcgctgtgcctccggcctccggagctctgactgcccactgcattggaggattctggagggaagtcggtgtggcctccgatcaaagcctggtgctgacggccccgaagcgggtggagggcttgttcctcaccttgagcgggagtaacctgaccgtgaaggttgcatataacagctcaggaagctgtgagatagagaagatcgtgggctcagaaatagacagtacgggaaaattcgcttttcctggccacagagagatccacgtgctggacaccgactacgagggctacgccatcctgcgggtgtccctgatgtggcggggcaggaactttcgcgtcctcaagtactttactcggagccttgaggacaaggaccggctggggttctggaagtttcgggagctgacagcagacactggtctctacctggcggcccggcctgggcggtgtgccgagctcctgaaggaggagctgatttaatggagttcctgcctcagaccacaaggttcggagcgcccgcccacccctgcccctcctgggcaccctgcccaccaggtcacctgcacctgctctgaataaactgtgaagtc

SEQ ID NO: 149491 - DNA, 531 bp, Homo sapiens
  Payload ID: 9517
  Gene Symbol: LCN9
  Gene Name: lipocalin 9
  Uniprot ID: Q8WX39
  ENST ID: ENST00000277526
  CDS Start-End: 1-531
atggctctgcttctgctgagcctggggctgagcctcatcgcagcccaggagttcgatccccacaccgttatgcagaggaactacaacgtggccagggtttcaggggtctggtattctattttcatggcctcagatgacctgaatcggattaaagaaaatggagacctgagggtcttcgtccggaatattgaacacttgaagaacggcagcctaatatttgatttcgaatacatggtgcagggggagtgtgtggctgtggtcgtggtctgcgagaagacagagaagaatggggaatactccatcaactatgagggccagaacacagtggccgtctcggagactgactacaggctgttcatcaccttccacctccagaacttcaggaacgggaccgagacccacacgctggcgctctatgaaacctgcgaaaagtacggacttggctcacaaaatatcatcgacttgaccaacaaagatccctgctactccaagcattacaggagcccgcccaggcctcccatgcggtggtaa

SEQ ID NO: 149492 - DNA, 528 bp, Homo sapiens
  Payload ID: 9517
  Gene Symbol: LCN9
  Gene Name: lipocalin 9
  ENST ID: ENST00000619315
  CDS Start-End: 1-528
atggctctgcttctgctgagcctggggctgagcctcatcgcagcccaggagttcgatccccacaccgttatgcagaggaactacaacgtggccagggtttcaggggtctggtattctattttcatggcctcagatgacctgaatcggattaaagaaaatggagacctgagggtcttcgtccggaatattgaacacttgaagaacggcagcctaatatttgatttcgaatacatggtgcagggggagtgtgtggctgtggtcgtggtctgcgagaagacagagaagaatggggaatactccatcaactatgagggccagaacacagtggccgtctcggagactgactacaggctgttcatcaccttccacctccagaacttcaggaacgggaccgagacccacacgctggcgctctatgaaacctgcgaaaagtacggacttggctcacaaaatatcatcgacttgaccaacaaagatccctgctactccaagcattacaggagcccgcccaggcctcccatgcgtgag

SEQ ID NO: 149493 - DNA, 1839 bp, Homo sapiens
  Payload ID: 9518
  Gene Symbol: LCNL1
  Gene Name: lipocalin-like 1
  Uniprot ID: Q6ZST4
  ENST ID: ENST00000408973
  CDS Start-End: 595-1089
aggcccaggtccccatccaggccaactttgatgccagccaggtgtgcccagccctgtttcctcctcatctccaatgagtcctcccggctttggtgctgcaccccgggtccctgtccacaccctctttgatccaggctcagcagggctaggggcaggggaaacccccacctcacccgctccgtctgactggagtaggggttggctggggaagactgcagcctccatcctaccttttcagttgcatcccccaacaatccccagggcccaaaatagggacaagttggttgcctgtgcctcactgtcccccacccaccccacaaagacctgtgaccttgccacagccccacccatccagccgtaccccctgggtgccagctgcagacaggccggtgctgggctggtgggggccagttgctcatgtactgaggcccccctccctcagttctgcatcggggtcgagatgtgtacagcagcccctgccgtggccaggaagcagctgtgtcggggcagaatgtggtgggctcaggcccagggcacaggggcggcctcccagccttccctgcacttgccctgcagttccagggcacctggtacatggtcggggtggtgtcagatgaccaggacttcctggactccaaggacaccatgaagatggctgtggtcttagtgacccccttggggaatggtgacctggccctcaagtttggataccccacgccccatggcgggtgccagaaaatggacacgaccttcaccgagggtgctgtaccggggcagttcagcaacccagccatggccctgagtgacatccgagtggccttctccgactaccagcactttgccttgctgtacttggagatgcggaaagggggcctgcggaaccagtggctgcagctctacggtgggcgggctgcggggcggagacccagacacccccgcttcgggtctgggatgtcacccctgtgcctgcaccagccctttctgcacgcggaaggtggaaccgctggctcctggtgtctgtggccgcgggtcccggcccctccctgcccctctctccctctcttcgcccctccagccccttccctttagcttacccgccctccccaccttcagctcgagcgcccgagctgtttcccgaaggcgcccagaagatgcagctactggcgccccaagtgggcctgagccccagccagggcgtcctgctgccgaagtcgggtgagcggtgccggcagccctgctgggagggccaggccccgggtcacacccctgctggaagggccaggccctggtcactccactgatctcagattcgggacagaagtgcccggggcagacccagcctgtctgggtcgggggagggcgagacgttgcccaggccggtgttcccaggaggagatcgccttggggcaggtcgggggcctccgtcccagggaagggggcgcggggtggcgcctcaggctcgatctctctgcagaccagtgtgcgggcgcgctctcccgggtgagtagaccatggccatgcggagccgcggaccatgggccctcccagctcggtgggctgcaccgcggggccctctaccttcggggcagctagggacgacagcgggggtgatggggcacccgggcggatccgagccgcagcagcctggggaaccgcggggctgcgcgtcgggagggggcggaggcaggggacgccgcccacctgctccttgttttgcagtgaggggtccagcccctgagtgcccgcaggggtcagctgctccgtgcgcccagccctgcccaaagagccccctccctccacaccctggccccaagcgcaataaacaccctgaatgcctgt

SEQ ID NO: 149494 - DNA, 1775 bp, Homo sapiens
  Payload ID: 9519
  Gene Symbol: LIAS
  Gene Name: lipoic acid synthetase
  Uniprot ID: O43766
  ENST ID: ENST00000261434
  CDS Start-End: 119-1237
agccaatcgtggagcagcttggctgcttgtcataaatggagcgacgtaatttcgacctgtcctttcccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaaaacttcaacaagaccttcaagatcacagaaatttttaaaatttgattccagttaataacagaggtggtgccagaatgcctggactgcagtggatgtgccccacctctttgcttaaaaaaaaaaatgtcaatagccaggcatagtggctcacgcctgtaatcccagcactttaggaggccaaggcgggtggatcacctgaggtcaggagttcgagaccagcctggccaacatggtgaaatcctgtctccactaaaaacacaaaaattagtcaggcgtggtagtgggtgcctgtaatcccagctactcgggaggctaaggcaggagaatcacttgaacctgggagggggaggttgcagtgagccaagatcgctccattgccctccagcctgggtgacaagagcaaaactccatctcaaataaataaaaaggaaaaaaaagtcaataaactgtacaaatttaattacagtaattcatttggcttttagtgtatcttctttgtcccaattaaacagttgcttgctgtgatgtaatcttaaaa

SEQ ID NO: 149495 - DNA, 1594 bp, Homo sapiens
  Payload ID: 9519
  Gene Symbol: LIAS
  Gene Name: lipoic acid synthetase
  Uniprot ID: O43766
  ENST ID: ENST00000340169
  CDS Start-End: 119-1087
agccaatcgtggagcagcttggctgcttgtcataaatggagcgacgtaatttcgacctgtcctttcccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggtgaatttttcctgaaaaatctagtggctaaaagaaaaacaaaagacctctaaaacttcaacaagaccttcaagatcacagaaatttttaaaatttgattccagttaataacagaggtggtgccagaatgcctggactgcagtggatgtgccccacctctttgcttaaaaaaaaaaatgtcaatagccaggcatagtggctcacgcctgtaatcccagcactttaggaggccaaggcgggtggatcacctgaggtcaggagttcgagaccagcctggccaacatggtgaaatcctgtctccactaaaaacacaaaaattagtcaggcgtggtagtgggtgcctgtaatcccagctactcgggaggctaaggcaggagaatcacttgaacctgggagggggaggttgcagtgagccaagatcgctccattgccctccagcctgggtgacaagagcaaaactccatctcaaataaataaaaaggaaaaaaaagtcaataaactgtacaaatttaattacagtaa

SEQ ID NO: 149496 - DNA, 1542 bp, Homo sapiens
  Payload ID: 9519
  Gene Symbol: LIAS
  Gene Name: lipoic acid synthetase
  Uniprot ID: O43766
  ENST ID: ENST00000381846
  CDS Start-End: 47-1036
gttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaaaacttcaacaagaccttcaagatcacagaaatttttaaaatttgattccagttaataacagaggtggtgccagaatgcctggactgcagtggatgtgccccacctctttgcttaaaaaaaaaaatgtcaatagccaggcatagtggctcacgcctgtaatcccagcactttaggaggccaaggcgggtggatcacctgaggtcaggagttcgagaccagcctggccaacatggtgaaatcctgtctccactaaaaacacaaaaattagtcaggcgtggtagtgggtgcctgtaatcccagctactcgggaggctaaggcaggagaatcacttgaacctgggagggggaggttgcagtgagccaagatcgctccattgccctccagcctgggtgacaagagcaaaactccatctcaaataaataaaaaggaaaaaaaagtcaataaactgtacaaatttaattacagtaattcatttggcttttagtgtatcttctttgtcccaatt

SEQ ID NO: 149497 - DNA, 821 bp, Homo sapiens
  Payload ID: 9519
  Gene Symbol: LIAS
  Gene Name: lipoic acid synthetase
  ENST ID: ENST00000513731
  CDS Start-End: 53-781
ccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaaaacttcaacaagaccttcaagatcacagaaatttttaaaa

SEQ ID NO: 149498 - DNA, 1880 bp, Homo sapiens
  Payload ID: 9520
  Gene Symbol: LSR
  Gene Name: lipolysis stimulated lipoprotein receptor
  Uniprot ID: Q86X29
  ENST ID: ENST00000347609
  CDS Start-End: 1-1776
atgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcaca

SEQ ID NO: 149499 - DNA, 2105 bp, Homo sapiens
  Payload ID: 9520
  Gene Symbol: LSR
  Gene Name: lipolysis stimulated lipoprotein receptor
  Uniprot ID: Q86X29
  ENST ID: ENST00000354900
  CDS Start-End: 108-2000
cgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 149500 - DNA, 1963 bp, Homo sapiens
  Payload ID: 9520
  Gene Symbol: LSR
  Gene Name: lipolysis stimulated lipoprotein receptor
  Uniprot ID: Q86X29
  ENST ID: ENST00000360798
  CDS Start-End: 115-1860
cgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgtgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcac

SEQ ID NO: 149501 - DNA, 2210 bp, Homo sapiens
  Payload ID: 9520
  Gene Symbol: LSR
  Gene Name: lipolysis stimulated lipoprotein receptor
  Uniprot ID: Q86X29
  ENST ID: ENST00000361790
  CDS Start-End: 160-2109
ctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatc

SEQ ID NO: 149502 - DNA, 1606 bp, Homo sapiens
  Payload ID: 9520
  Gene Symbol: LSR
  Gene Name: lipolysis stimulated lipoprotein receptor
  Uniprot ID: Q86X29
  ENST ID: ENST00000427250
  CDS Start-End: 22-1503
agacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaatgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcac

SEQ ID NO: 149503 - DNA, 343 bp, Homo sapiens
  Payload ID: 9520
  Gene Symbol: LSR
  Gene Name: lipolysis stimulated lipoprotein receptor
  ENST ID: ENST00000599658
  CDS Start-End: 1-343
gacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagtgtatgccgccggcaaagcagccacctcaggtgttcccagcatttatgcccccagcacctatgcccacc

SEQ ID NO: 149504 - DNA, 297 bp, Homo sapiens
  Payload ID: 9520
  Gene Symbol: LSR
  Gene Name: lipolysis stimulated lipoprotein receptor
  ENST ID: ENST00000602003
  CDS Start-End: 144-297
gtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaagctcctgccagggccatccaggtgaccgtgtccaacccctaccacgtggtgatcctc

SEQ ID NO: 149505 - DNA, 530 bp, Homo sapiens
  Payload ID: 9520
  Gene Symbol: LSR
  Gene Name: lipolysis stimulated lipoprotein receptor
  ENST ID: ENST00000601623
  CDS Start-End: 112-530
aggaagtgaaactccctggacgctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcat

SEQ ID NO: 149506 - DNA, 2480 bp, Homo sapiens
  Payload ID: 9520
  Gene Symbol: LSR
  Gene Name: lipolysis stimulated lipoprotein receptor
  Uniprot ID: Q86X29
  ENST ID: ENST00000602122
  CDS Start-End: 488-2377
agactcgctcctcccggcagggcgcacctaggcgggtccatcgccagccggggagaggggtttgggcagggagggaacaggtgcgcggcgggacccgccctatctcaacaggtgaatcgctccaagtgggtctcggttgcatggatctcggtgcgcttggtttggccggagcagatgggggccggaagggacctgtggtccgcaggcgccctcccagcgggccagtcacttggttcgggccctgggggacggagcgcacctgggtcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcac

SEQ ID NO: 149507 - DNA, 1885 bp, Homo sapiens
  Payload ID: 9520
  Gene Symbol: LSR
  Gene Name: lipolysis stimulated lipoprotein receptor
  ENST ID: ENST00000605618
  CDS Start-End: 5-1810
cgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccc

SEQ ID NO: 149508 - DNA, 2274 bp, Homo sapiens
  Payload ID: 9520
  Gene Symbol: LSR
  Gene Name: lipolysis stimulated lipoprotein receptor
  Uniprot ID: Q86X29
  ENST ID: ENST00000621372
  CDS Start-End: 224-2173
tcagcccacttccggggagggaggcagaggaacccctccccgccgctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatc

SEQ ID NO: 149509 - DNA, 2110 bp, Homo sapiens
  Payload ID: 9521
  Gene Symbol: LHFP
  Gene Name: lipoma HMGIC fusion partner
  Uniprot ID: Q9Y693
  ENST ID: ENST00000379589
  CDS Start-End: 464-1066
gtgcgatccccggcgcccgcgcgcgcccacagcgctccgccagagctgccgccgcggactcgccgggagtgggggtctccgctggtgccagcccgcttctggagaccctccgcctcctgccaacccctgctcttccaggtcgggccccggggttctgcggctgttagggacagaggcaaagaagggcaggacggtccggtttcccgtggatgttcccgcccgagaaagacagcaagttgtgtgtgcgcccgggacgcgggagggaaggtggccgccgcccgccagccatggaccatcatctttagtgcagaggatggaaagttgatgcccagtaagactgaagatccattctgcattacggaactgtggattatctgtgggtccctggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcagaatggaggatctgcaccatagtgaccggcctgggttgtggcctcctcctcctggtggcgctcactgccctcatgggttgctgtgtttccgacctcatctccaggacagtgggaagagtggctggaggaattcagtttcttgggggcttgttgattggtgctggctgtgccctctaccccttgggctgggacagtgaggaagtccggcagacttgtggctacacttctggccagtttgacctggggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaata

SEQ ID NO: 149510 - DNA, 1675 bp, Homo sapiens
  Payload ID: 9522
  Gene Symbol: LHFPL1
  Gene Name: lipoma HMGIC fusion partner-like 1
  Uniprot ID: Q86WI0
  ENST ID: ENST00000371968
  CDS Start-End: 241-903
tgcctgtatgtctgaggctgggtttgaagcctccagcgtgtttggagttaatccccattaggttggactccgcccctttctcccaaaggtaaagcaaggttttcaggcatcactgcaaagggcagctagtattcccatccttgtctaacaagctgtaaggagaagttgtttctgagatctgagcctgaagagagggaacaagtcagtcagccttcgtggtcagaagagaaacctgtgaccatgaggagcagcctgaccatggtgggaaccctctgggccttcctgtcccttgttactgctgtgaccagttctaccagttacttcctaccttactggctctttggatcccagatggggaagccagtgtcattcagcacattccggaggtgcaactaccctgtgcggggagagggacacagtctgatcatggtggaagaatgtgggcgctatgccagcttcaatgccatcccaagcctggcctggcagatgtgcacagtggtgacaggtgccggctgtgctctgctgctcctggtggcactagctgctgtcctgggttgctgcatggaggagctcatctccagaatgatgggacgttgcatgggagcagcgcagtttgttggagggctgctgataagctcaggctgtgccttataccctttaggatggaatagcccggagataatgcaaacatgtgggaatgtctccaatcaatttcagttaggtacctgtcggcttggctgggcctattactgtgctggaggtggagcagctgcagccatgttgatctgcacctggctctcttgctttgctggaagaaaccccaagcctgtcatattggtggagagcatcatgaggaataccaattcttatgctatggagcttgaccattgcctcaaaccttgagctttgaaagaagattggagagggtgggaaaggggaggagggagccctgaaaagaggtactaaggattaggccatttgtcatctgactgtcattagcatagcctagtgtttgcatgctttttaaactaattgtcgttcattttcacttatctttaagccagtaggtcactggctgtttataaaattcatcagaggaaacattctcagacatttacccaactggcaagtcgtgctaacccgaagacccaaagtacccctttatgcaaaataggatccaaagctaaggctgggtaagaatagttgtgcagggagggagcacgagatgggcagagctggttcctaccactccattcacacagttcatcagttcattcccaagtatttattgtcacccccaaacatctctggagtactactgctcaatttttgtgtcgttatcaggagtataccttggctcttcctttttttctcctgcttccccccgcaccttgtggggaagcttcaggggagcgggggagggtgattcccagtggtggggaaaacattaatcaaggatacttgcatttagcctggagccccttcctcattatgctttagaatattcataggagttccatttgtattctggctgggtgatgagcaaaaaaaatatatagtagcaaatattctctcatcctttagagataaagaaatggtgttcatcaaatgtactgagaatagactagcatttgtggggcactcaataaatttaaattcatggtgacagtgacaa

SEQ ID NO: 149511 - DNA, 5043 bp, Homo sapiens
  Payload ID: 9523
  Gene Symbol: LHFPL2
  Gene Name: lipoma HMGIC fusion partner-like 2
  Uniprot ID: Q6ZUX7
  ENST ID: ENST00000380345
  CDS Start-End: 677-1363
gggcagggcggctcggccgcctctttctctcgctgcccccgcccctcctcctcctccctctccccgagtgctagcccgggcggccgccgagcttggcgctctctcgcctcgctgcctcctcccccgcgccgcggaccctctcccctcccttgcgttgcccccctctcccgccgcctcctcccgctctcctctcgctctcctcccgcctccttcttccaggcgcggccagcgggggcaagagcgaggtggctgcgaggaggcgtcactgaaagccctgacttggggaaggctgcgggctcggagccggagacgccgagctggggccgggtgagttgggaatcagactcttgagttgacagctggcctatggtttctgcattttgttaagaagcacctcatgcaagcgagggacctgggactgctcacagccaggtggcatttttctgaagttgttcattaagacttcccagcattcctacagatataaataggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgaaggataataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcattcttattctttc

SEQ ID NO: 149512 - DNA, 4680 bp, Homo sapiens
  Payload ID: 9523
  Gene Symbol: LHFPL2
  Gene Name: lipoma HMGIC fusion partner-like 2
  Uniprot ID: Q6ZUX7
  ENST ID: ENST00000515007
  CDS Start-End: 312-998
acacgtgaaggaagcctttgtgggccttcctgcgcagctgactagctgaaagccatcgtgagccagcccaggagaaaccagcagaggaacagccagccgaaccctgggattgtgagaaataatcaggtgaggccgcaggcggtgctctgggtccgggagcgctgtccccagcatgaacgcggccggcggcgggagtgaatgactgcagctgcgacttccttcccgggccgcccgagcctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgaaggataataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcattcttattctttcaa

SEQ ID NO: 149513 - DNA, 1378 bp, Homo sapiens
  Payload ID: 9524
  Gene Symbol: LHFPL3
  Gene Name: lipoma HMGIC fusion partner-like 3
  ENST ID: ENST00000401970
  CDS Start-End: 123-779
gtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagatgatggaaatgcttaaggcaaactaaggtagtgtgagaccacaccatttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttc

SEQ ID NO: 149514 - DNA, 1852 bp, Homo sapiens
  Payload ID: 9524
  Gene Symbol: LHFPL3
  Gene Name: lipoma HMGIC fusion partner-like 3
  Uniprot ID: Q86UP9
  ENST ID: ENST00000424859
  CDS Start-End: 167-835
ctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactca

SEQ ID NO: 149515 - DNA, 4880 bp, Homo sapiens
  Payload ID: 9525
  Gene Symbol: LHFPL4
  Gene Name: lipoma HMGIC fusion partner-like 4
  Uniprot ID: Q7Z7J7
  ENST ID: ENST00000287585
  CDS Start-End: 287-1030
gcaagatggaggccgcgcagaggccgccgcctgggccgaggcagccgctgctgggagcgccgagccgcggcgcctaggccgtgccagtcccggatccgctgcctccggccgtgcccagcagctcccagacgcccccagctctgccccaggccccgccctcgcgggttccttgactcagggccgcttctcgcgtgcgtccccagctcccgcccggcagcccggcgctccgtcccgggccggcggcccccgccagccgccgccgccgccggccccgcctccgggcaccatgctgccctcgcaggaggcctccaagctctaccacgagcactacatgcggaactcgcgggccatcggcgtgctgtgggccatcttcaccatctgcttcgccatcatcaacgtggtggtcttcatccagccctactgggtgggcgacagcgtgagcacccccaagcctggctacttcggcctcttccactactgcgtgggcagcgggctggcgggccgcgagctcacctgccggggctccttcaccgacttcagcaccatcccgtccagcgccttcaaggcggccgccttcttcgtgctgctctccatggtgctgatcctcggctgcatcacctgcttttcgcttttcttcttctgcaacacggctacggtctacaagatctgcgcctggatgcagctcttggcagctctgtgcctcgtcctgggctgcatgatctttcctgatggctgggatgccgagaccatccgggacatgtgtggggccaagacggggaagtactccctgggggactgttcagtgcgctgggcatacatcctggccatcatcggcatcctcaacgccctcatcctctccttcctcgccttcgtgctgggcaaccggcaaacagacctgctgcaggaggagctcaagccggagaacaaagattttgtgggctctacagtaagctccgtgttgcggcccgggggtgatgtctctggatggggagtccttccctgccccgtggctcactcacagggaccctgaaaggccaggatcacagcccagtaattggcctgacctcagcttgtcctgccttctgccctctcgtcactccattcaagctctgagggaagaccctgatctcagacttacttctcaccgactaccctgcaagctccaggctttgaggagaggaaagcctggatgtggcctgggggagaggagaggccctccaaaccttgggagggtctaattcttgctcctccctcaatttgacctaagggagcctgcatctgcgtaggcccttgggcttctcctctcctctctagactggcctggaggtccctgcagatccccagggagagcggagctgtagttccagctccccaggccccctcagtctggagggctgccgcctggctgtatccgcacctcttctggtccctgcctcttcaagaaatttattctagatactgctccagggtgggctggactctttcctactttttttttttttcttttttggctgatgttggttccaccacatctgccacaaagctccaggtgccaccagtctcccctgggacctcctctgctccattccggcctgctcccagctcaccctgagggagagctgcaccgagggatgcacagggccctgctgtcagctgcagaccggggccctgatcagcccagagtcagaaaagactttcaggctctggaggtagcgggagggggtacgtggcctcggcagttggagcttagaagctgctcagcccgggctggcctggcctcctcttcctctctgctggaacatctcactgatgactgagcccttgaccttggcctcttttgcccaggcctcctctctgctgggatgtctcaccaatgactggacccttgaccctggcctgttttgtacagcacagacttcttggccctgttgtcagggttgggggtgtggaggggaccccagaggtggggagttgggggatgcattaccccttctgccccttttcatgccctccataccccaggcgtctaccaagggcagagactgtcttgtctctttgatacttttctgcataacttgaacttgcaggtcatctctgaacagggtacccctgtcccccttcctaagccttgttaccctgtcccagcctcttcctcctcctggcccacctctcgccttgcgatatgcccagggtctgcacctatgggcagtgcttggagccgaggcatgagtgtatgtgtatgtgggtgaaatgtgtgtgcgtgtgtgtgcgcgtgtgagcgtgtgtgtgtgtgtgtgtgttgggggacaggtgagaagtttctcccccctccacccactgtgggggcgtctcccttccccttggcagggagcaggtgagggagactcctggtattttttgaacacccgtcattcccctgtgggtctggcggcagagccatctctcccggggagcctccctgccctggggcctggacagctccctcagcactagttgctggtgcagaccggcttcgtccagcgccccctcctggcggcctggacctgcagggaaggggcggtgccctgcaggatgccaggggaagccgcctcgggcctcggcggaggggagagggtcgcttgagcgccatgtgtttgccaaccttgtgttcatttccacaggacttggacctgagagttagggtttccaagaaagaccctagaagtcccctgcctgtctccccactctggaccctagccggaatcagatgttgggacctagtgggttcctgccacctggaacttaccaagtcccgacttcactcctccacttactcctcccgggcaaagcctccccgcagtgctctggtcccagcgctgggctccccttccccgccggcgccttcccggacagtccagtcggcctggggtaggggcgctgcgggacagagggtccgagttaaatgcgggaggatgcgggagccccgtgggagggagttggggtaggagggagttcctcaaagatgcaaaccaagcccagcgttggagggggagagcagagttaggagagagtgaggggaggggcgcagcaagcgactgggaatgggagaagacactggggtgaggagaagaggggtgcagagacagggagatgagagatgattggagaaggagcgagggggacgcacaggcacagagaaacagcgcgaggaggagagatcgagagagacggggcagaggtggagagagatgagagaccagctgagaggctgcccgagagcttggggtgggggaggggaaatggatgaaaaggcggaaaaaggactcgggagcggggaagaggtaaatggagatgtgggttgggggcaagaatgggatgcagaggaaggagaggaggatgaaggagccaggatgcggggcagtggggagggggttgctatctgggcactgggtgaggggagagcttgttcccccaaggacgcctgccaccaggtgtccttgccacaccttgttccccaaggacacccaccaaacctgtgccctggtgcgggggatagaactgacctttcagaggctggaggcccggggcacaggcagccaaggccgcatccttttgggaagaactggagtgaaggaagccacttcagaggacgtagtgggtccagctgacttaggagtgggtcagcgccgggtggagaggagggaggctagttccctggtggggtagcctggcaacattcccattccaccgcacctggccagctgccatcttggcagagccagggggagatgcaccagggagtttggagtcaggaaggcagagttgtgtgggctgaagtctgcgggaaccccagggtgacacaggcaaggggtagaagtcagagtggggaccaaaccatagactggggccctgggttctgcagaggtgtggatggggcaggtggcaggtgctccagtgggggccccaggtgaggccctgatggccctcctggggcaataaagacatcatgggaagggggctttgtggtttgcctctgctctcgtcgggcgatctggctttagccttcaggaggaggtaagcagaggagatcagtgcctgtttctgaccccaggagggccttgttgggctccaacctagagccttccggcttcaggtcccaagagaagtccccccctaactgtgacccccctaactgtgatcaggggtctgccattgcccgcttttctctgcctgatctggggactcaggagaggccacggcagccacagcctaggggtggttcagtccctggcccacagtctggtcagttgagtccttctgggaaccggggctatgaaaactttcgtctttggggaccggtacccatgaaggaaaactttcctgagggggtgaggaccaaagaatcaagatccttttcaggcctgatagccaagatgatgagaacttttagataaggctgtggggagagtccctggccttttgagcatcctgcttgggcacacggggaataacctttctccagcttccagtgtgaactgagaaagagaaagggaaaccctgtctttggagaagctgggatgttcccagcaccagaaacttctgcaggcccctgcctggcccacggctaacctttgggtgggactggagtttcctgaacagggaacaagggagccttccgcagagctctgatgggcaggcctccgagggcctgtgctgtgtgctgttaggatagcttggtgttgtctataccccattagtaagttttgtctgagtgtgtcctcgctgttcattgtctaatttggtaacatttattttggtcctgaccccttctgctgctgctgggtttaagcttcagtgcaggtggaatgacattcaaataaagaaacactttctatcaccca

SEQ ID NO: 149516 - DNA, 2148 bp, Homo sapiens
  Payload ID: 9526
  Gene Symbol: LHFPL5
  Gene Name: lipoma HMGIC fusion partner-like 5
  Uniprot ID: Q8TAF8
  ENST ID: ENST00000360215
  CDS Start-End: 379-1038
ggggcgctggccgcggtgctgaaacggcgccctccgcggacggaggagggggcggggctctcgggagccgtgagccgggaagagggagacgggcagggcggcgccagcaggccctggtgggcttgggaggaggcaggagactggagacagcctcggctagagcggacacaggcacctggcaagctttccttgaccaaatcaaggttgtccttgtcctattaagcctcttccccttgccttgaagggacctcacctggtgccctgacctcagcctcctccccaaaccccgctggggagtgacctgcttctaggcctccatccacaaagctacggacttgcagcccacgggaccccagcccagggcctgctgccctcaccatggtgaaattgctgccggcccaggaggcagccaagatctaccataccaactatgtgcggaactcgcgagccgtgggcgtgatgtggggtaccctcaccatctgcttctccgtactggtcatggccctcttcatccagccctactggatcggcgacagcgtcaacacaccgcaggcaggctacttcggccttttctcctactgcgtgggtaacgtgctgtcctccgagctcatctgcaagggcggccccctagacttctcctccatcccctctagagccttcaagactgccatgttctttgtggccttgggcatgttcctcatcattggctccatcatctgcttcagcctgttcttcatctgcaacacggccacagtctataagatctgtgcatggatgcagctggctgcggccacaggcctaatgattggctgcctggtctaccctgatggttgggactcaagtgaggtgcggcgcatgtgtggggagcagacgggcaagtacacgctgggccactgcaccatccgctgggccttcatgctggccatcctcagcattggcgacgccctcatcctctccttcctggccttcgtgttgggctaccggcaggacaagctcctccctgacgactacaaggcagatggaaccgaggaggtgtgaagcagctgaagggtcggtcatctatttcccagacacaggaaaactagggaatcaaattcttcagagataagaacttgttcttccaagtttccttgttcctggctactataggcctgaagcctgaagccttttattataacactaaaactggacagtctcctgagacaagacctcctactgtactctttctggggaagcagaactgcagtgacccacttcaaagatattcagaggctgagcggtgcagggagtgctcagttgctggggatgggatccaagtccatttcttagttccacacagcagcaaatcgcttcaccttcttgaagcctctcctctgtaaagcgagagggctaaatgggtccatctctaggggccttccctcccaggtctgtgtctgatagcatacacacacacatatatatacacacacacacacacacacacacacacacacacacatacatacacacacacatatatatacacacacacacacacacacacacacacactctctctctctctcaaacacacacaaatgcccaaccagctctaagagggcactgaagaggtggctggacatgtgctgggtcatttttagggtgaggtgtagggggtcttttgcttctcccttctcatattttgttttcttattgctgctcagaggggggtaaggaatggaggggccatcagaacttgaatcctttaacatccaccaggaagttttatgaagagtgggtgataggatctaaaatctctgcagacttttttcctcccgggagccaaatatcacatttccttatggtgcccacactgactcaaccagaactggctaccagcttcagaaatgtgttacttatgttcaagtaatttgttataggaatagatgacatttttttttttcaaaaactttggatttggcatatagtcatctatagggggattggttccaggatcccctgcagatgccaaaatacatggatgcccaagtcctcagctaaaaatagcgtagtatttgcatataacctatgcacatcctcctgtatactttaaatcatctctagattacttataatacctaatacaatgtaaatgctatgtaaatactc

SEQ ID NO: 149517 - DNA, 1961 bp, Homo sapiens
  Payload ID: 9527
  Gene Symbol: LBP
  Gene Name: lipopolysaccharide binding protein
  Uniprot ID: P18428
  ENST ID: ENST00000217407
  CDS Start-End: 162-1607
gatgtcgcaagcaggttccagtccctgtgcctccccttcccgctcccaggaacccatccagcctcaggaactgcccccagccatcgagccttggctacttaagggacctgggcccaatccacagctgggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattagctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcagtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccccgactggcctgggatatctttacaagcaggcactgtatttttttattcgccatctgatccccatgcctagcagagtgctggcacttagtaggtcctcaataaatatttattaaatgatgagatgatggaa

SEQ ID NO: 149518 - DNA, 2356 bp, Homo sapiens
  Payload ID: 9528
  Gene Symbol: LITAF
  Gene Name: lipopolysaccharide-induced TNF factor
  Uniprot ID: Q99732
  ENST ID: ENST00000339430
  CDS Start-End: 234-719
gtttctctccctgcccccgcgacttcgcgcaagatccgggaaggacacccgaggcccctgggagaccctggggaggtgaaaatcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggt

SEQ ID NO: 149519 - DNA, 1527 bp, Homo sapiens
  Payload ID: 9528
  Gene Symbol: LITAF
  Gene Name: lipopolysaccharide-induced TNF factor
  Uniprot ID: Q99732
  ENST ID: ENST00000381810
  CDS Start-End: 7-693
ggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctgggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcactt

SEQ ID NO: 149520 - DNA, 2292 bp, Homo sapiens
  Payload ID: 9528
  Gene Symbol: LITAF
  Gene Name: lipopolysaccharide-induced TNF factor
  Uniprot ID: Q99732
  ENST ID: ENST00000413364
  CDS Start-End: 71-529
ccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggcaggagtgcagtggtacgatcgtagctctccgcagctttgatctcctgggctcctgcaatccgcccagctcagcctcctgagtacctgggaccacaggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtg

SEQ ID NO: 149521 - DNA, 556 bp, Homo sapiens
  Payload ID: 9528
  Gene Symbol: LITAF
  Gene Name: lipopolysaccharide-induced TNF factor
  ENST ID: ENST00000576334
  CDS Start-End: 458-556
agtaacccattttctctgggacccctttcttcgcagagagcgcttctctttctttcgcctattacacttctgctcttaacttcagtctggtgtgtccgcatcctagttttgcatggctgtcagacaacaaatctcgggtatttaccccagacaacgacgctgcttcactagcacccattccatctggagcaagcacacctgattgccccagcccggctccgaggaggctggagaattgcaagccttctaaggagggaaatttctccatgcttgggatggagctcagagcctgggtagccccacacaataccctccagccacatctcctgtaaataccccgtgtctttgtgctacccagagcccgagtctggccccatgtgcccgtgtaggtgtggaaccctgccacctgcgacacaggtcttcgaggagtcaaaaagggtaacttcctgacgttgccatgacatttgtaaactgtcatggtgctggtgggagtgtagcagtgaggaagaccagagttcgccctcgtcgccgtcttggttttggtaaaatgtcggtt

SEQ ID NO: 149522 - DNA, 516 bp, Homo sapiens
  Payload ID: 9528
  Gene Symbol: LITAF
  Gene Name: lipopolysaccharide-induced TNF factor
  ENST ID: ENST00000572255
  CDS Start-End: 275-481
agacctcccggctcgacaggcggcgcgggcggcggagttgaatccccctgggggttttcaagttgttcttggactgctggtttttgaaatagaagcccctttggtggggtcccccataaacccaggcgctggtgcccaccttgtgatgtgaaggctcctgtaacacgacctcactttcctggccccgcactactcacctgccccacgggacacagttaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgca

SEQ ID NO: 149523 - DNA, 593 bp, Homo sapiens
  Payload ID: 9528
  Gene Symbol: LITAF
  Gene Name: lipopolysaccharide-induced TNF factor
  ENST ID: ENST00000570798
  CDS Start-End: 182-593
gacctcccggctcgacaggcggcgcgggcggcggaatttccccagagctacagtgagggtggaaaaaagaggatctgcaagaggaagtcctgtattcttggcactgtgacttgtcctctatttgttttcgcttttacagcagtgaaaatagccccgtgggtgaggcggtctatcaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcg

SEQ ID NO: 149524 - DNA, 553 bp, Homo sapiens
  Payload ID: 9528
  Gene Symbol: LITAF
  Gene Name: lipopolysaccharide-induced TNF factor
  ENST ID: ENST00000574701
  CDS Start-End: 145-553
gaaagtggggagagccgcgagcggcaaatcaggagggagggccaggctgtcgggggcggacgggtggggctggcaccgagaggcaggggcaggataggagagtgggggagacaccaggtccgcgccaggcgtctcgggggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggcaggagtgcagtggtacgatcgtagctctcc

SEQ ID NO: 149525 - DNA, 587 bp, Homo sapiens
  Payload ID: 9528
  Gene Symbol: LITAF
  Gene Name: lipopolysaccharide-induced TNF factor
  ENST ID: ENST00000571277
  CDS Start-End: 469-587
agacctcccggctcgacaggcggcgcgggcggcgaattataaatgtgtttgtgtggctgtttgatctcaaagcaatgctcagaagatgcagtgtctcgaaatcccagaagataagatgttaccacatgaaagatggtctcaataaagggggagaggcggtggccgaggccttaatttccaaaacgagaaactggggcccacccatcttttaaaggtcgtcaaaagaaagctcccatcctcccatcccccacacctgtgtgttgactctgtaaagatgcagtttcctcactttgggaggagaggccgtggtttttgcaggaattgcgccgctgccgaattcagccattgcctcttggaggtttaggatgccccaggccttgttttccctcaaagcattccattggcaatcacgaccaaccatgctccttgaggatttctgtacacactggcttttcctggtcttgtaaaatgtcggttccaggaccttaccaggcggccactgggccttcctcagcaccatccgcacctccatcctatgaagagacagtggctgttaacagttattaccccacacctccagctcccat

SEQ ID NO: 149526 - DNA, 582 bp, Homo sapiens
  Payload ID: 9528
  Gene Symbol: LITAF
  Gene Name: lipopolysaccharide-induced TNF factor
  ENST ID: ENST00000575426
  CDS Start-End: 1-32
accgaagtgactctgccaaagagtctaagtgaagtgccattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaa

SEQ ID NO: 149527 - DNA, 1118 bp, Homo sapiens
  Payload ID: 9528
  Gene Symbol: LITAF
  Gene Name: lipopolysaccharide-induced TNF factor
  Uniprot ID: Q99732
  ENST ID: ENST00000570904
  CDS Start-End: 103-588
caggctgtcgggggcggacgggtggggctggcaccgagaggcaggggcaggataggagagtgggggagacaccaggtccgcgccaggcgtctcgggggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaa

SEQ ID NO: 149528 - DNA, 2632 bp, Homo sapiens
  Payload ID: 9528
  Gene Symbol: LITAF
  Gene Name: lipopolysaccharide-induced TNF factor
  Uniprot ID: Q99732
  ENST ID: ENST00000571688
  CDS Start-End: 232-717
gctaaaaactttaccatcttcccagttcactcccagtcggtcttaggagacaggaccgctattgtgcccattttgcagacaggaagccgagctcagagaggatgggtaacatgcccgaaggcacagagagtgtcttggtctgtccggacgcgtctgtagagttacaggaagagaagggccgccctccagagggccgggagcgccccagcgcgggtccggggtcgaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaagagaa

SEQ ID NO: 149529 - DNA, 677 bp, Homo sapiens
  Payload ID: 9528
  Gene Symbol: LITAF
  Gene Name: lipopolysaccharide-induced TNF factor
  ENST ID: ENST00000571459
  CDS Start-End: 24-251
caggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaagtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagt

SEQ ID NO: 149530 - DNA, 554 bp, Homo sapiens
  Payload ID: 9528
  Gene Symbol: LITAF
  Gene Name: lipopolysaccharide-induced TNF factor
  ENST ID: ENST00000574848
  CDS Start-End: 291-554
aagcagtaacccattttctctgggacccctttcttcgcagagagcgcttctctttctttcgcctattacacttctgctcttaacttcagtctggtgtgtccgcatcctagttttgcatggctgtcagacaacaaatctcggaccctccagccacatctcctgtaaataccccgtgtctttgtgctacccagagcccgagtctggccccatgtgcccgtgtaggtgtggaaccctgccacctgcgacacaggtcttcgaggagtcaaaaagggtaacttcctgacgttgccatgacatttgtaaactgtcatggtgctggtgggagtgtagcagtgaggaagaccagagttcgccctcgtcgccgtcttggttttggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcct

SEQ ID NO: 149531 - DNA, 486 bp, Homo sapiens
  Payload ID: 9528
  Gene Symbol: LITAF
  Gene Name: lipopolysaccharide-induced TNF factor
  ENST ID: ENST00000574703
  CDS Start-End: 40-357
agacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaagtacgtgtggcctcccaggccccccttaccattccttggccctccaccctgggaatcaggagagtgaccgaagtgactctgccaaagagtctaagtgaagtgccagtacgttccagttttacccccttaccttgaaattccacacgcagtcttttagattccatgttggtgaggctcacagcttttccgtaataaagtatggtttaggatctttcccatggtcatca

SEQ ID NO: 149532 - DNA, 548 bp, Homo sapiens
  Payload ID: 9528
  Gene Symbol: LITAF
  Gene Name: lipopolysaccharide-induced TNF factor
  ENST ID: ENST00000571976
  CDS Start-End: 62-442
ggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgagtctgcctcccacttggccccaagccatcctgcccttctctctgggtgctggcgggggtgggttctcaactgcaccatgcttgacattcagggccagacatttgtg

SEQ ID NO: 149533 - DNA, 579 bp, Homo sapiens
  Payload ID: 9528
  Gene Symbol: LITAF
  Gene Name: lipopolysaccharide-induced TNF factor
  ENST ID: ENST00000571627
  CDS Start-End: 119-579
aggaaaagaaacccgccttgagccaccgcagctcgtgccaggggtctcagatgatggacagacactgatatggaggttcaaatttcgggaaacacagcaacagcccagccatggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctct

SEQ ID NO: 149534 - DNA, 773 bp, Homo sapiens
  Payload ID: 9528
  Gene Symbol: LITAF
  Gene Name: lipopolysaccharide-induced TNF factor
  ENST ID: ENST00000573332
  CDS Start-End: 40-285
agacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaatgaatgctattggccttgtttcctgagcaacctgtgtttgtccctctccctttcatcagttaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttgga

SEQ ID NO: 149535 - DNA, 603 bp, Homo sapiens
  Payload ID: 9528
  Gene Symbol: LITAF
  Gene Name: lipopolysaccharide-induced TNF factor
  Uniprot ID: Q99732
  ENST ID: ENST00000576036
  CDS Start-End: 94-579
ccctgcgctcagccttctgagccttcctcatctgatgcctgttaggctccctttgctgctgaggtcctgggtgccatcccagcacttggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagc

SEQ ID NO: 149536 - DNA, 717 bp, Homo sapiens
  Payload ID: 9528
  Gene Symbol: LITAF
  Gene Name: lipopolysaccharide-induced TNF factor
  Uniprot ID: Q99732
  ENST ID: ENST00000574763
  CDS Start-End: 221-706
agacctcccggctcgacaggcggcgcgggcggcggagttgaatccccctgggggttttcaagttgttcttggactgctggtttttgaaatagaagcccctttggtggggtcccccataaacccaggcgctggtgcccaccttgtgatgtgaaggctcctgtaacacgacctcactttcctggccccgcactactcacctgccccacgggacacaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccag

SEQ ID NO: 149537 - DNA, 692 bp, Homo sapiens
  Payload ID: 9528
  Gene Symbol: LITAF
  Gene Name: lipopolysaccharide-induced TNF factor
  Uniprot ID: Q99732
  ENST ID: ENST00000620789
  CDS Start-End: 234-692
gtttctctccctgcccccgcgacttcgcgcaagatccgggaaggacacccgaggcccctgggagaccctggggaggtgaaaatcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggcaggagtgcagtggtacgatcgtagctctccgcagctttgatctcctgggctcctgcaatccgcccagctcagcctcctga

SEQ ID NO: 149538 - DNA, 2467 bp, Homo sapiens
  Payload ID: 9528
  Gene Symbol: LITAF
  Gene Name: lipopolysaccharide-induced TNF factor
  Uniprot ID: Q99732
  ENST ID: ENST00000622633
  CDS Start-End: 71-556
ccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaag

SEQ ID NO: 149539 - DNA, 3846 bp, Homo sapiens
  Payload ID: 9529
  Gene Symbol: LPL
  Gene Name: lipoprotein lipase
  Uniprot ID: P06858
  ENST ID: ENST00000311322
  CDS Start-End: 471-1898
tttaacgtgaatcgatgtaaacctgtgtttggtgcttagacagggggcccccgggtagagtggaaccccttaagctaagcgaacaggagcctaacaaagcaaatttttccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccac

SEQ ID NO: 149540 - DNA, 629 bp, Homo sapiens
  Payload ID: 9529
  Gene Symbol: LPL
  Gene Name: lipoprotein lipase
  ENST ID: ENST00000524029
  CDS Start-End: 241-629
gacaaacaggattcgtcaaaagagaggtgtattaaagtgccgatcaaatgtaatttaacagctaaactttccctccttggaaaacagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaact

SEQ ID NO: 149541 - DNA, 560 bp, Homo sapiens
  Payload ID: 9529
  Gene Symbol: LPL
  Gene Name: lipoprotein lipase
  ENST ID: ENST00000520959
  CDS Start-End: 216-560
aacagtttgtatgctggaagagttctgaaaagatctctgagggctggaagtgctaaggacaatttcataaagaagaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtat

SEQ ID NO: 149542 - DNA, 559 bp, Homo sapiens
  Payload ID: 9529
  Gene Symbol: LPL
  Gene Name: lipoprotein lipase
  ENST ID: ENST00000522701
  CDS Start-End: 243-559
aaactttccctccttggaaaacagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactc

SEQ ID NO: 149543 - DNA, 554 bp, Homo sapiens
  Payload ID: 9529
  Gene Symbol: LPL
  Gene Name: lipoprotein lipase
  ENST ID: ENST00000519773
  CDS Start-End: 186-305
agactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccttattttgaagttacagatttttaaattttgagttgaaaaaaaagagcaaatttagattaaggaatgagaagtagtcctcgcagcctcatgaatctcctgaaatttcgaacggcaaaatctaaaatctacaagttattaccttcttacagtaaatagaaagaagagattttatcgacatcgaaagtaaatttgccctaaggacccctgaagacacagctgaggacacttgccacctcattcccggagtagcagagtccgtggctacctgtcatttcaatca

SEQ ID NO: 149544 - DNA, 6414 bp, Homo sapiens
  Payload ID: 9530
  Gene Symbol: LPA
  Gene Name: lipoprotein, Lp(a)
  Uniprot ID: P08519
  ENST ID: ENST00000316300
  CDS Start-End: 46-6168
ctgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 149545 - DNA, 1839 bp, Homo sapiens
  Payload ID: 9530
  Gene Symbol: LPA
  Gene Name: lipoprotein, Lp(a)
  Uniprot ID: P08519
  ENST ID: ENST00000447678
  CDS Start-End: 1-1839
agtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtccca

SEQ ID NO: 149546 - DNA, 1713 bp, Homo sapiens
  Payload ID: 9530
  Gene Symbol: LPA
  Gene Name: lipoprotein, Lp(a)
  ENST ID: ENST00000614786
  CDS Start-End: 1-1713
agtggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgcg

SEQ ID NO: 149547 - DNA, 3970 bp, Homo sapiens
  Payload ID: 9531
  Gene Symbol: LOXHD1
  Gene Name: lipoxygenase homology domains 1
  Uniprot ID: Q8IVV2
  ENST ID: ENST00000300591
  CDS Start-End: 415-3759
agtacctcttcagtaacactgatactttgtggaggggttatgagagaattgcaggcagggccccagcacctagagcccatgggccagctgacccacaggaacaaacagagaatggcgttgagtggcagatgctgaggcacttggttcctggtgtggtctgcttcctcccgtgcatggagcagtgtgtgcattcacatggtgtgatccatatggccctcttcacacctaaatggtgggcaaatccgtcttcagtttctgacagtcactttggatttgcacagcaccagctcatagcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagagctgggccatgacggggcctcccctgagagctgctggctggtggaagagttgtgtttggcagtgcccacccagggcaccaagtacatgttgaactgtaactgctggctggccaaggacagaggcgacggcatcacctcccgtgtcttcgacctcttggatgccatggtggtgaacattggggtgaaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctggtagtgaccaggctgggacttgctgcagagtgtggatgagaaattgagtcttcacccaggggatagaagtggagaagcagaggccatcaagatggtgtattttaagcaaaaactaattaacacttttccccaaaaaagctaggctaattaaattattaccaaccatatcctataaagaactcatcttagcatctgcttgctaagaagtgtatacttttccccagtttcaataaacccagtggcaagtgga

SEQ ID NO: 149548 - DNA, 1958 bp, Homo sapiens
  Payload ID: 9531
  Gene Symbol: LOXHD1
  Gene Name: lipoxygenase homology domains 1
  Uniprot ID: Q8IVV2
  ENST ID: ENST00000398686
  CDS Start-End: 221-1759
ctgcctcacagaggaagaaccgaggtgggggcttggtgaaggcacaccaggaagagcaggctgcgcctcaccctccagtggagacagagggcagacattctctttggagcacacctcaggctaaatggcaaaaccccaatctcaagtgaacatcatggaactaggggattgtctcacttctccagtggattgaggcagtgctccctctgttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaaggtgcgcctggagcacgacagcagtggctactgctcaggctggctggtggagaaggtggaggtcaccaacaccagcaccggcgtggccaccatcttcaactgtggcaggtggctggacaagaagcggggggatggactcacctggagagacctcttcccttctgtctgaggggctagggcccccaccctctcactgagatgccccaatctcacatttctgccctccaccttggcggtcagcagcccttcaaagcctctagcattggcactgggggctagcagtccactgagaacttcatggggtcctgctccccaccctacccccagtttattgaacctacagtgataataattagcatgtgtcataa

SEQ ID NO: 149549 - DNA, 1824 bp, Homo sapiens
  Payload ID: 9531
  Gene Symbol: LOXHD1
  Gene Name: lipoxygenase homology domains 1
  Uniprot ID: Q8IVV2
  ENST ID: ENST00000398705
  CDS Start-End: 206-1579
agaaccgaggtgggggcttggtgaaggcacaccaggaagagcaggctgcgcctcaccctccagtggagacagagggcagacattctctttggagcacacctcaggctaaatggcaaaaccccaatctcaagtgaacatcatggaactaggggattgtctcacttctccagtggattgaggcagtgctccctctgttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaagtagtgaccaggctgggacttgctgcagagtgtggatgagaaattgagtcttcacccaggggatagaagtggagaagcagaggccatcaagatggtgtattttaagcaaaaactaattaacacttttccccaaaaaagctaggctaattaaattattaccaaccatatcctataaagaactcatcttagcatctgcttgctaagaagtgtatacttttccccagtttcaataaacccagtggcaagtgg

SEQ ID NO: 149550 - DNA, 6226 bp, Homo sapiens
  Payload ID: 9531
  Gene Symbol: LOXHD1
  Gene Name: lipoxygenase homology domains 1
  ENST ID: ENST00000441551
  CDS Start-End: 1-6204
atgatgccccagaagaaaaggcggaggaagaaggacatcgacttcctggccctgtacgaagcggagctgctgaactacgcctcggaggacgacgagggggagctggaacacgagtactacaaggccagagtgtatgaagtggtcacagccacgggggatgttcgcggtgcagggacggatgccaatgtcttcatcacgctttttggagagaatgggctctctcccaagctccagctcaccagcaagagcaagtctgcctttgagaagggcaacgtcgatgtgttccgggtgagaaccaacaatgtgggcctcatctataaagtcaggattgagcatgacaacacgggcttgaatgccagctggtacctggaccatgtgattgtgaccgacatgaagaggcctcatctccgttactacttcaactgcaacaactggctgagcaaggtggaaggtgaccgccagtggtgccgtgacctgctggccagcttcaaccccatggacatgcccagaggtaataagtatgaagtcaaggtatacactggtgatgtaattggtgcagggacagatgctgatgtcttcatcaatatttttggagagtatggagacacaggggagcgtaggctagaaaatgaaaaggacaactttgaaaagggagctgaagacaggttcatcctggatgccccggatttggggcagctgatgaagatcaatgttggccacaacaataaggggggctctgcaggttggttcctgtcccagatagtcattgaagatattgggaacaaaagaaaatatgacttcccccttaaccgctggctggccttggacgaagacgatggcaaaatccaaagggatatcttagtgggcggagctgagaccacagctattacgtatattgtcaccgtcttcactggggatgtccggggggctggtaccaaatccaaaatctacttggtcatgtatggggccagagggaataagaacagtgggaaaatcttcctggagggcggcgtgtttgaccgaggccgcacggacatcttccacatcgagctggctgtcctccttagccccctgagtcgggtctccgtcgggcatggcaatgtgggtgtcaacagaggctggttctgtgagaaggtggtgattctgtgccccttcactggtatccagcagaccttcccttgtagcaactggctggatgagaagaaagcggatgggttgattgagaggcagctctatgagatggtgtctctcaggaagaagcggctgaaaaaattcccttggtccctgtgggtctggacaaccgacctaaagaaagctggtaccaactctcccatcttcatccagatttatgggcagaaggggcggacagatgagattctcctgaatcccaacaacaagtggttcaaacccggcataatcgagaagtttaggattgagctcccggatcttggcaggttttataagattcgagtatggcatgataaaaggagttctggttctggatggcatttagaaaggatgaccctgatgaacactctgaacaaagacaagtacaacttcaattgcaaccgctggctggatgccaatgaggatgacaatgagatagtgagggaaatgactgcagaaggcccaacagtgcgcaggatcatgggcatggcccggtaccatgtgactgtgtgcacaggtgaacttgaaggtgctgggaccgatgccaacgtctatctctgcctttttggtgatgtgggggacacgggggaacggctgctctacaactgcaggaataacacagacctgtttgaaaagggcaatgctgacgagttcactatcgagtctgtcaccatgcggaatgtgaggcgggtgaggatcagacacgatggcaaaggctccggcagcggctggtacctggacagagtgctggtgagagaggaggggcagcctgagagcgacaacgtggagttcccatgtctcaggtggttggacaaggataaggatgatgggcagctggtccgagagttgctacccagtgacagcagcgcgacactgaagaactttcgctatcacatcagcttgaagactggggatgtctctggggccagcacggattctagagtctacatcaagctctatggggataaatctgacaccatcaagcaagttcttcttgtctctgacaacaacctcaaagactactttgaacgtggccgggtggatgagttcaccctcgagaccctgaacattggaaatatcaaccggctggtgattgggcatgacagcactggcatgcatgccagctggttcctgggcagcgttcagatccgtgtgccccgtcaaggcaagcagtacacctttcccgccaaccgctggctggacaagaaccaggctgacgggcgcctggaggtggagctgtatcccagcgaggtggtggagatccagaaattggtccactatgaggttgagatttggacaggagatgtgggtggcgcaggcaccagtgcccgagtctacatgcagatctatggagagaaaggcaagacagaagtgctcttcctctccagccgctcaaaagtttttgaacgggcgtccaaggacacattccagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagagctgggccatgacggggcctcccctgagagctgctggctggtggaagagttgtgtttggcagtgcccacccagggcaccaagtacatgttgaactgtaactgctggctggccaaggacagaggcgacggcatcacctcccgtgtcttcgacctcttggatgccatggtggtgaacattggggtgaaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaaggtgcgcctggagcacgacagcagtggctactgctcaggctggctggtggagaaggtggaggtcaccaacaccagcaccggcgtggccaccatcttcaactgtggcaggtggctggacaagaagcggggggatggactcacctggagagacctcttcccttctgtctgaggggctagggcccccaccctct

SEQ ID NO: 149551 - DNA, 675 bp, Homo sapiens
  Payload ID: 9531
  Gene Symbol: LOXHD1
  Gene Name: lipoxygenase homology domains 1
  ENST ID: ENST00000414184
  CDS Start-End: 135-675
cagcagtagagtggtgataggaaagatggcatctgggatactgtgaatctctgagtctcacggtgcagccaatggtgtccacacaataccctccttaactgaaaaagcctggagggcaagaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctg

SEQ ID NO: 149552 - DNA, 556 bp, Homo sapiens
  Payload ID: 9531
  Gene Symbol: LOXHD1
  Gene Name: lipoxygenase homology domains 1
  ENST ID: ENST00000419859
  CDS Start-End: 488-556
actttgtggaggggttatgagagaattgcaggcagggccccagcacctagagcccatgggccagctgacccacaggaacaaacagagaatggcgttgagtggcagatgctgaggcacttggtagggatgcgggggttcaagaggaagtcctcgccgcaagatggtgtcttgggggaaaactagggggagggagcaacttaaactgggccttggcaggttcctggtgtggtctgcttcctcccgtgcatggagcagtgtgtgcattcacatggtgtgatccatatggccctcttcacacctaaatggtgggcaaatccgtcttcagtttctgacagtcactttggatttgcacagcaccagctcatagcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccag

SEQ ID NO: 149553 - DNA, 560 bp, Homo sapiens
  Payload ID: 9531
  Gene Symbol: LOXHD1
  Gene Name: lipoxygenase homology domains 1
  ENST ID: ENST00000452425
  CDS Start-End: 390-560
attgttcaccaaaggatccaccatcaacagcagtagagtggtgataggaaagatggcatctgggatactgtgaatctctgagtctcacggtgcagccaatggtgtccacacaataccctccttaactgaaaaagcctggagggcaagaggtctgagcttcggtcctggctccatctctaactggtcaaatgacctgggataaattatataaacgcacaggtcaggccaggcaggaggcagatgcctggtgctaggatctgaggacacacagccatttggtggcccagaagcctctgtttcacctgaccctgtgggtttctctttttggctcatggctatggggtcaacagaaggccccagcccttatctctggtactgaatcaaaaccaatgggcttcttggaccaggtcagaagctgtcccacaaaggttctctatgaaatgacggtgtggacaggggatgtggttggcgggggcactgactccaacatcttcatgaccctctacggcatcaacgggagcacagaggagatgcagctggacaaaaagaaagccaggttt

SEQ ID NO: 149554 - DNA, 1358 bp, Homo sapiens
  Payload ID: 9531
  Gene Symbol: LOXHD1
  Gene Name: lipoxygenase homology domains 1
  ENST ID: ENST00000536111
  CDS Start-End: 192-1112
gaaccagggtcctgacctggagtctgacctctgccagaaactcatcaggtcaccctggacaagtcatgccatctttatgggcttttgtttcctcttctgataaatgggcttaatgttgccagcctaacttcttaagatgttctgaaaatccaaggcatttaagcttggaaaggaaaaagtgccacagaaccatgaggctggggacaaactgtgaacatccccagcttccccttgcagctccatcagggtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagactagagatggggtttcaccatgttggccaagctggtcttgaaatcctgacatcagggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacaggg

SEQ ID NO: 149555 - DNA, 6848 bp, Homo sapiens
  Payload ID: 9531
  Gene Symbol: LOXHD1
  Gene Name: lipoxygenase homology domains 1
  ENST ID: ENST00000536736
  CDS Start-End: 1-6636
atgatgccccagaagaaaaggcggaggaagaaggacatcgacttcctggccctgtacgaagcggagctgctgaactacgcctcggaggacgacgagggggagctggaacacgagtactacaaggccagagtgtatgaagtggtcacagccacgggggatgttcgcggtgcagggacggatgccaatgtcttcatcacgctttttggagagaatgggctctctcccaagctccagctcaccagcaagagcaagtctgcctttgagaagggcaacgtcgatgtgttccgggtgagaaccaacaatgtgggcctcatctataaagtcaggattgagcatgacaacacgggcttgaatgccagctggtacctggaccatgtgattgtgaccgacatgaagaggcctcatctccgttactacttcaactgcaacaactggctgagcaaggtggaaggtgaccgccagtggtgccgtgacctgctggccagcttcaaccccatggacatgcccagaggtaataagtatgaagtcaaggtatacactggtgatgtaattggtgcagggacagatgctgatgtcttcatcaatatttttggagagtatggagacacaggggagcgtaggctagaaaatgaaaaggacaactttgaaaagggagctgaagacaggttcatcctggatgccccggatttggggcagctgatgaagatcaatgttggccacaacaataaggggggctctgcaggttggttcctgtcccagatagtcattgaagatattgggaacaaaagaaaatatgacttcccccttaaccgctggctggccttggacgaagacgatggcaaaatccaaagggatatcttagtgggcggagctgagaccacagctattacgtatattgtcaccgtcttcactggggatgtccggggggctggtaccaaatccaaaatctacttggtcatgtatggggccagagggaataagaacagtgggaaaatcttcctggagggcggcgtgtttgaccgaggccgcacggacatcttccacatcgagctggctgtcctccttagccccctgagtcgggtctccgtcgggcatggcaatgtgggtgtcaacagaggctggttctgtgagaaggtggtgattctgtgccccttcactggtatccagcagaccttcccttgtagcaactggctggatgagaagaaagcggatgggttgattgagaggcagctctatgagatggtgtctctcaggaagaagcggctgaaaaaattcccttggtccctgtgggtctggacaaccgacctaaagaaagctggtaccaactctcccatcttcatccagatttatgggcagaaggggcggacagatgagattctcctgaatcccaacaacaagtggttcaaacccggcataatcgagaagtttaggattgagctcccggatcttggcaggttttataagattcgagtatggcatgataaaaggagttctggttctggatggcatttagaaaggatgaccctgatgaacactctgaacaaagacaagtacaacttcaattgcaaccgctggctggatgccaatgaggatgacaatgagatagtgagggaaatgactgcagaaggcccaacagtgcgcaggatcatgggcatggcccggtaccatgtgactgtgtgcacaggtgaacttgaaggtgctgggaccgatgccaacgtctatctctgcctttttggtgatgtgggggacacgggggaacggctgctctacaactgcaggaataacacagacctgtttgaaaagggcaatgctgacgagttcactatcgagtctgtcaccatgcggaatgtgaggcgggtgaggatcagacacgatggcaaaggctccggcagcggctggtacctggacagagtgctggtgagagaggaggggcagcctgagagcgacaacgtggagttcccatgtctcaggtggttggacaaggataaggatgatgggcagctggtccgagagttgctacccagtgacagcagcgcgacactgaagaactttcgctatcacatcagcttgaagactggggatgtctctggggccagcacggattctagagtctacatcaagctctatggggataaatctgacaccatcaagcaagttcttcttgtctctgacaacaacctcaaagactactttgaacgtggccgggtggatgagttcaccctcgagaccctgaacattggaaatatcaaccggctggtgattgggcatgacagcactggcatgcatgccagctggttcctgggcagcgttcagatccgtgtgccccgtcaaggcaagcagtacacctttcccgccaaccgctggctggacaagaaccaggctgacgggcgcctggaggtggagctgtatcccagcgaggtggtggagatccagaaattggtccactatgaggttgagatttggacaggagatgtgggtggcgcaggcaccagtgcccgagtctacatgcagatctatggagagaaaggcaagacagaagtgctcttcctctccagccgctcaaaagtttttgaacgggcgtccaaggacacattccagcttgaggcggccgacgtgggcgaggtctataagctccggctcgggcacacgggcgagggctttgggcccagctggttcgtggacaccgtgtggctgcggcacctggtggtgcgggaggtggacctcacgccggaggaggaggcccggaagaagaaggagaaggacaagctgcggcagctgctcaagaaggagcggctgaaggccaagctgcagaggaagaagaagaagaggaagggcagcgacgaagaggacgagggggaggaagaggagtcgtcctcatcagaggagtcctcgtcagaggaggaggagatggaagaagaggaggaagaggaggagtttgggccggggatgcaggaggtgattgagcagcacaagttcgaagcccaccgctggctggcccggggcaaggaggacaacgaacttgtcgtggagttggtgccagctggcaagccgggtcctgagcgaaacacctatgaggttcaggtggtcacggggaatgtgcccaaggccggcactgatgctaacgtctacctaaccatctacggcgaggagtatggagacacgggcgaacgacccctgaagaagtcagacaagtccaacaaatttgagcaggggcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaaggtgcgcctggagcacgacagcagtggctactgctcaggctggctggtggagaaggtggaggtcaccaacaccagcaccggcgtggccaccatcttcaactgtggcaggtggctggacaagaagcggggggatggactcacctggagagacctcttcccttctgtctgaggggctagggcccccaccctctcactgagatgccccaatctcacatttctgccctccaccttggcggtcagcagcccttcaaagcctctagcattggcactgggggctagcagtccactgagaacttcatggggtcctgctccccaccctacccccagtttattgaacctacagtgataataattagcatgtgtcataatctgtggctgccc

SEQ ID NO: 149556 - DNA, 3755 bp, Homo sapiens
  Payload ID: 9531
  Gene Symbol: LOXHD1
  Gene Name: lipoxygenase homology domains 1
  ENST ID: ENST00000582408
  CDS Start-End: 241-3543
gatactttgtggaggggttatgagagaattgcaggcagggccccagcacctagagcccatgggccagctgacccacaggaacaaacagagaatggcgttgagtggcagatgctgaggcacttgacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaaggtgcgcctggagcacgacagcagtggctactgctcaggctggctggtggagaaggtggaggtcaccaacaccagcaccggcgtggccaccatcttcaactgtggcaggtggctggacaagaagcggggggatggactcacctggagagacctcttcccttctgtctgaggggctagggcccccaccctctcactgagatgccccaatctcacatttctgccctccaccttggcggtcagcagcccttcaaagcctctagcattggcactgggggctagcagtccactgagaacttcatggggtcctgctccccaccctacccccagtttattgaacctacagtgataataattagcatgtgtcataatctgtggctgccc

SEQ ID NO: 149557 - DNA, 3632 bp, Homo sapiens
  Payload ID: 9531
  Gene Symbol: LOXHD1
  Gene Name: lipoxygenase homology domains 1
  ENST ID: ENST00000579038
  CDS Start-End: 352-3387
gggctgggtgacgttggaggatgagagtgggctggctgtgacactggaggatgagggcgagctggctgtgacatccgagggtactactttccatgccaacgttggctggcagtggaggaagatgatggccagctgtccagggagctgttgccagtggatgagtcctatgtgctgccacagagcgaggagggtaggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatttgttccttacgagatcaccctctacaccagtgatgtctttgctgctgggacagatgccaacatcttcatcatcatctatggctgcgatgccgtgtgcacccagcagaagtatctgtgtaccaacaagagggaacagaagcagttctttgagaggaagtctgcctcccgcttcatcgtagagttagaagatgtgggagaaatcattgaaaaaattcggattggccataataacacgggcatgaatcctgggtggcactgctctcacgtggacatccgcaggctcctcccggataaagacggtgcagagaccttgactttcccatgcgatcggtggcttgccacctctgaggatgacaaaaagaccattcgagaactggttccatatgacatcttcactgagaaatacatgaaagatgggtccttacggcaagtctacaaggaagtagaagagcctctggacattgtgctgtactcggtgcagatcttcacagggaacattcctggggcagggacggatgccaaggtgtacatcaccatctatggagacctcggggacactggggagcgataccttggcaagtcagagaaccggaccaacaagttcgagagaggaacggctgacaccttcatcatcgaggccgctgacctaggcgtcatctacaagatcaagctccgccatgacaactccaagtggtgcgcagactggtacgtggagaaggtggagatctggaatgacaccaacgaggacgagttcctgttcctatgcgggcgctggctctccctgaagaaggaggatgggcgactcgagaggctcttttacgagaaggagtacactggggaccgcagcagcaactgcagcagccctgctgacttctgggagatcgccctgagctccaagatggccgatgtcgacatcagcacagtgaccgggcccatggctgactacgttcaagagggcccaattattccctactatgtgtcagtcaccactgggaagcacaaggacgcggccactgacagccgagccttcatctttctcatcggggaggatgatgaacgtagtaagcgcatctggttggactacccccgagggaagaggggcttcagccgtggctctgtggaggagttctacgtcgcaggcttggatgtgggcatcatcaagaaaatagagctgggccatgacggggcctcccctgagagctgctggctggtggaagagttgtgtttggcagtgcccacccagggcaccaagtacatgttgaactgtaactgctggctggccaaggacagaggcgacggcatcacctcccgtgtcttcgacctcttggatgccatggtggtgaacattggggtgaaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaagtagtgaccaggctgggacttgctgcagagtgtggatgagaaattgagtcttcacccaggggatagaagtggagaagcagaggccatcaagatggtgtattttaagcaaaaactaattaacacttttccccaaaaaagctaggctaattaaattattaccaaccatatcctataaagaactcatcttagcatctgcttgctaagaagtgtatacttttccccagtttcaataaacccagtggcaagtgg

SEQ ID NO: 149558 - DNA, 1018 bp, Homo sapiens
  Payload ID: 9532
  Gene Symbol: LIPT2
  Gene Name: lipoyl(octanoyl) transferase 2 (putative)
  Uniprot ID: A6NK58
  ENST ID: ENST00000310109
  CDS Start-End: 31-726
cggggccccgcggacgcaacggtgggcacgatgcggcaacccgccgttcggttggtgcgcctgggtcgggtgccgtacgccgagctactggggctgcaggaccgctggctgcggcggctgcaggccgagccaggcattgaggccccgtcggggactgaggcgggcgcgctcctgctctgcgagcccgcggggcccgtgtatacggccgggctgcgcggcggcctgacgcccgaggaaactgcgcggctacgggccttgggcgccgaggtgcgcgtcacaggccgcggtggcctggccaccttccacggcccgggccagctgctttgccacccggtactcgacctgcggcgtctcggcctgcgcttgcgcatgcacgtagcgtcgctggaggcgtgcgccgtgcgcctgtgcgagctccagggcctgcaggacgcccgcgcgcggcccccgccctacactggcgtctggctagacgatcgcaagatctgcgcgatcggagtccgctgtggaaggcacatcacatcccacggcctggctctcaactgctctaccgacctcacgtggtttgagcacatcgtgccctgtggactggttgggacaggcgtcacttccttgagtaaggagctccagaggcacgtcaccgtggaagaagtaatgccacctttccttgtggcctttaaggagatctacaagtgcacactgatctcagaggacagccccaactgaagagtactcataacagccaggatgctcctgccttgggaagcatgaagtctgacttgagtcacctactgaaacccagattttagacctggcctgtcattcactgatcatgaaactaaggacataccatgagctctgagccactattttcatatgtatcctgttttatttatatcttccccacctacctcagagatactagatgtgacaatactgtgaaaagcaacacatgctatataaaacattagcactgctattgacagcagtgtctcagagaaattcagatgtcatagat

SEQ ID NO: 149559 - DNA, 769 bp, Homo sapiens
  Payload ID: 9532
  Gene Symbol: LIPT2
  Gene Name: lipoyl(octanoyl) transferase 2 (putative)
  ENST ID: ENST00000527115
  CDS Start-End: 1-236
agggcctgcaggacgcccgcgcgcggcccccgccctacactggcgtctggctagacgatcgcaagatctgcgcgatcggtgagcgccgcggagcagggcggtacctgagagccgaggagtccgctgtggaaggcacatcacatcccacggcctggctctcaactgctctaccgacctcacgtggtttgagcacatcgtgccctgtggactggttgggacaggcgtcacttccttgagtaaggagctccagaggcacgtcaccgtggaagaagtaatgccacctttccttgtggcctttaaggagatctacaagtgcacactgatctcagaggacagccccaactgaagagtactcataacagccaggatgctcctgccttgggaagcatgaagtctgacttgagtcacctactgaaacccagattttagacctggcctgtcattcactgatcatgaaactaaggacataccatgagctctgagccactattttcatatgtatcctgttttatttatatcttccccacctacctcagagatactagatgtgacaatactgtgaaaagcaacacatgctatataaaacattagcactgctattgacagcagtgtctcagagaaattcagatgtcatagattgttatttctcgattgttgatgtcatagattgtcatttctcaattgttgcttcctcaatactgtgtctaactgagcaattctgggctctagttcctttgattttgtgggaatcaaatctctgaatggccca

SEQ ID NO: 149560 - DNA, 218 bp, Homo sapiens
  Payload ID: 9532
  Gene Symbol: LIPT2
  Gene Name: lipoyl(octanoyl) transferase 2 (putative)
  ENST ID: ENST00000528085
  CDS Start-End: 1-218
actggggctgcaggaccgctggctgcggcggctgcaggccgagccaggcattgaggccccgtcggggactgaggcgggcgcgctcctgctctgcgagcccgcggggcccgtgtatacggccgggctgcgcggcggcctgacgcccgaggaaactgcgcggctacgggccttgggcgccgaggagtccgctgtggaaggcacatcacatcccacggcct

SEQ ID NO: 149561 - DNA, 1289 bp, Homo sapiens
  Payload ID: 9533
  Gene Symbol: LIPT1
  Gene Name: lipoyltransferase 1
  Uniprot ID: Q9Y234
  ENST ID: ENST00000393471
  CDS Start-End: 99-1220
agcatcgcgcgcaaggcctgccggttgctcggggtcgtatgacgcacttttccagctcgagccctcacgaggccgtgggtacgaccggaagccgcagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtc

SEQ ID NO: 149562 - DNA, 1424 bp, Homo sapiens
  Payload ID: 9533
  Gene Symbol: LIPT1
  Gene Name: lipoyltransferase 1
  Uniprot ID: Q9Y234
  ENST ID: ENST00000393473
  CDS Start-End: 225-1346
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcctgccaccacgcccagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaaaaaaa

SEQ ID NO: 149563 - DNA, 482 bp, Homo sapiens
  Payload ID: 9533
  Gene Symbol: LIPT1
  Gene Name: lipoyltransferase 1
  ENST ID: ENST00000449211
  CDS Start-End: 77-482
ggttgctcggggtcgtatgacgcacttttccagctcgagccctcacgaggccgtgggtacgaccggaagccgcagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagag

SEQ ID NO: 149564 - DNA, 885 bp, Homo sapiens
  Payload ID: 9533
  Gene Symbol: LIPT1
  Gene Name: lipoyltransferase 1
  ENST ID: ENST00000434566
  CDS Start-End: 132-885
ggggtcgtatgacgcacttttccagctcgagccctcacgaggccgtgggtacgaccggaagccgcagttcagtgatggggagccgtgtttggcagtgcagaggtagcgaagtgtcccaagaacatggaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacgg

SEQ ID NO: 149565 - DNA, 803 bp, Homo sapiens
  Payload ID: 9533
  Gene Symbol: LIPT1
  Gene Name: lipoyltransferase 1
  ENST ID: ENST00000415142
  CDS Start-End: 486-803
aaaccgggatgttgcgggccgtagcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgattcagtgatggggagccgtgtttggcagtgcagaggtagcgaagtgtcccaagaacatggaagactgaatctcgctctgttgcccagcccatctcggcccactgaaacctccacctcccgggttcaagcgattctcctgcctcagcctcccgagtagctgagattacaggcgcctgccaccacgcccagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtc

SEQ ID NO: 149566 - DNA, 583 bp, Homo sapiens
  Payload ID: 9533
  Gene Symbol: LIPT1
  Gene Name: lipoyltransferase 1
  ENST ID: ENST00000436234
  CDS Start-End: 466-583
gatgttgcgggccgtagcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgagtaagttgtatatcattagagaggggacaaaataatagggtcttggcgaggtcttatgaagaagctgcgcctgcctagaaagatagatgggattgtgctgttttcgctttcagttcagtgatggggagccgtgtttggcagtgcagaggtagcgaagtgtcccaagaacatggaagcatgctgatcccattttcaatgaagaattgcttccagttactttgtaactgccaggtcccagcagctggctttaaaaaaacagtaaaaaatgggctcattttacagtcaatttccaatg

SEQ ID NO: 149567 - DNA, 7685 bp, Homo sapiens
  Payload ID: 9534
  Gene Symbol: LTN1
  Gene Name: listerin E3 ubiquitin protein ligase 1
  Uniprot ID: O94822
  ENST ID: ENST00000361371
  CDS Start-End: 81-5381
ccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttct

SEQ ID NO: 149568 - DNA, 7749 bp, Homo sapiens
  Payload ID: 9534
  Gene Symbol: LTN1
  Gene Name: listerin E3 ubiquitin protein ligase 1
  Uniprot ID: O94822
  ENST ID: ENST00000389194
  CDS Start-End: 7-5445
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttct

SEQ ID NO: 149569 - DNA, 2714 bp, Homo sapiens
  Payload ID: 9534
  Gene Symbol: LTN1
  Gene Name: listerin E3 ubiquitin protein ligase 1
  ENST ID: ENST00000389195
  CDS Start-End: 7-2448
cagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggaatgtacctgccgtgaagtgcaaatactcacatctgtgtggaagaaaatcctcttcctgagcagtgattggaagttcctagccagtgtttgctgcctgcgcttccatgactcactagcctcctcatctccttacagctaggcagcttctttcattagatatgttcatactggcatatctcagagacatcattgctttgaaatgaaccaagttgcaaattccttacttctcagcccttaaagcaaaagaagctctgggaacatggatcagcatgctttaggggtggatttacagcttttttttttcttgcttccccacctcatgaaaataagttgctgtcagatatctggccctagtaactctatatcagagaatttggggaaataaatcccattgttcatattgaa

SEQ ID NO: 149570 - DNA, 1753 bp, Homo sapiens
  Payload ID: 9534
  Gene Symbol: LTN1
  Gene Name: listerin E3 ubiquitin protein ligase 1
  ENST ID: ENST00000483326
  CDS Start-End: 1-1099
ttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagtaatcaacacagaagacttctgtgaccaaatatgtggagatttctcccacccagcaagcagtcagttctgcagcagataccagctatgtgtcctccaattcaattctgactatctacctggagatagtgtcagatctcactggcttaggactcagtcccacaagaccgctccccacttctgatgccaatcgcaagccccaggctgttttacctgggcttctgaccaaccagctgtacatctaaatcagggatcccatgaccccctcctggggtttgcttaatttgctagactgtctcacagaactcagagaaacaatttaccagtttattataaatgatattacaaaggatacaaatgaagacatgcacacgttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagt

SEQ ID NO: 149571 - DNA, 7756 bp, Homo sapiens
  Payload ID: 9534
  Gene Symbol: LTN1
  Gene Name: listerin E3 ubiquitin protein ligase 1
  Uniprot ID: O94822
  ENST ID: ENST00000614971
  CDS Start-End: 14-5452
agtggggcagcaaatggacagggtgggtggcggaaaagggcccgggggaagttattacagggtgtcctcttccgccgccagaagccggaagttgtgtcccggacgtgtcaaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactcttttgtacttct

SEQ ID NO: 149572 - DNA, 2207 bp, Homo sapiens
  Payload ID: 9535
  Gene Symbol: LEAP2
  Gene Name: liver expressed antimicrobial peptide 2
  Uniprot ID: Q969E1
  ENST ID: ENST00000296877
  CDS Start-End: 1374-1607
aggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgtgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcagtctccttactcagaattcacagctttcccctcaaacttaaaatgcccatgtcatttcacgagtacccataactacccatcgtttagatacatgtcctcccttggtctagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattgaaattttagcagtctggaattcaagcttttgagggaaagaaggattcattttgtatactaaagaaaaaaacagcattgcccaataatgtgttaacttctcaatctggaaagtgtagtgagagctacataatcaatagctacgtaatcaacttcagcaagttcctaagctgtggccctggatcccttcactccatactcttcagggaggtgtcaaaggtggtcaagcttgggaggctgaggcaggagaatcacttgaacctgggaggtggaggttgcagtgagccaagatcatgccactgcaccccagcctgggtgacatagagagactctgtctcaaaaaaaaaaaaaaaa

SEQ ID NO: 149573 - DNA, 761 bp, Homo sapiens
  Payload ID: 9536
  Gene Symbol: LKAAEAR1
  Gene Name: LKAAEAR motif containing 1
  Uniprot ID: Q8TD35
  ENST ID: ENST00000302096
  CDS Start-End: 141-725
gtgcggaactcaaaaccgactgcggagagcccagcgggcgggagctggggcgcacgttggggccctgccgaggggcgggcagggcccggtgccagccccggcaccgacgggacgccctcctccctccgcagggcgggaggatgccgccgccagcgaaggagggcgggcgcaagggcccgcgggagcgaagcgggaagagcgcgccaggcacggcgcagggtgaggagcgtgccaagggggcgcccgcgacagagccccccaagccgggctgggccctgacgccgcagggactggcggccatgctccctgcgcagcgccaccgccatctgctcttcggcgacctgctggaggacgtgggcgcggcggcctccaccttcccgtgcgggtcggtggaaccggggtaccgcatgcccgacccgcgcccgtggacgcagtcgctcgagctgcccgccgagcgccagaaccggctcctcggcgtcctcaaggcagcggaggcccgcgggcgagtccgcgccctgcggctgcgctacacccgcatgcgggccgaggagatcgcgctgctcatccagcggcagaagtccgcgcgcgccgccatccggctggagctgttcctgccgccgcagctgaagcccgcgcggatcccggaccccctggaccgccaagagcggaggcgcgtggagaccatcctggaggagaacgtggatggcaccatcttcccgcggtgacggcgactgagagtgtgcgacgcgccccagcctccc

SEQ ID NO: 149574 - DNA, 868 bp, Homo sapiens
  Payload ID: 9536
  Gene Symbol: LKAAEAR1
  Gene Name: LKAAEAR motif containing 1
  Uniprot ID: Q8TD35
  ENST ID: ENST00000308906
  CDS Start-End: 141-863
gtgcggaactcaaaaccgactgcggagagcccagcgggcgggagctggggcgcacgttggggccctgccgaggggcgggcagggcccggtgccagccccggcaccgacgggacgccctcctccctccgcagggcgggaggatgccgccgccagcgaaggagggcgggcgcaagggcccgcgggagcgaagcgggaagagcgcgccaggcacggcgcagggtgaggagcgtgccaagggggcgcccgcgacagagccccccaagccgggctgggccctgacgccgcagggactggcggccatgctccctgcgcagcgccaccgccatctgctcttcggcgacctgctggaggacgtgggcgcggcggcctccaccttcccgtgcgggtcggtggaaccggggtaccgcatgcccgacccgcgcccgtggacgcagtcgctcgagctgcccgccgagcgccagaaccggctcctcggcgtcctcaaggcagcggaggcccgcgggcgagtccgcgccctgcggctgcgctacacccgcatgcgggccgaggagatcgcgctgctcatccagcggcagaagtccgcgcgcgccgccatccggctggagctgttcctgccgccgcagctgaagcccgcgcggatcccggaccccctggaccgccaagaggtgcagacaagccccggtaggggcggggaaaggggaggggccctgcccgcctccgcacacgccggaccccagcctctctccccggcagcggaggcgcgtggagaccatcctggaggagaacgtggatggcaccatcttcccgcggtgacggcgactgagagtgtgcgacgcgccccagcctcccacataaagttataattctc

SEQ ID NO: 149575 - DNA, 3348 bp, Homo sapiens
  Payload ID: 9537
  Gene Symbol:
  Gene Name: LL0XNC01-16G2.1
  ENST ID: ENST00000436629
  CDS Start-End: 355-2091
atgtctcctcctgtctagccacttgtcttccacagagactacgaaatttttcttcctcatctacctggggcttctgggagaagcgggaagccctgtagtcttagcacagcgggctttggagacccctgcgctgcgcagcgcggccgcgtgactgaggcgagatcttccaccctcctgctccagggcctctaggtggcctccagagtgggctccacagcttgaaggcggcgtttttccgcgggtggtcgcagcgtccgcagagtcggagaaagctgcgtcagagactgcaacagtcagcacacattcctgtctgatcaggctccctccctcaagtcctctgcgatagctctggcgatgcttcaggactggtgcaggaggatgggtgtgaacgcagagcgctctctgctcatcctggatatccctgacgactgcgaggaacatgagttccaggaggccgtgcgggctgccctgtcgcccctgggcaggtaccgagtgctcatcaaggtcttcagaaaggagctcggggccagggcagccttggtggaattcgctgagggtttaaaccaaagcttgattccccgccaaatagcaggcaaagggggaccctggaaagtgatctccctgccccaggcccttgatgctgagtttcaggatatacccagtttccctgcacagccccaggggcaagcagtggccagaggtgcaggtgaagcaggagctgcaggtgaggcaggatctgtaggtgaggcaggaggtgtgaatgaggaaagatctgcaggtgaagatgaggcaggaggtataggtgaggcaggaggtgtaggtgaggcaggagcagcaggtgaggcaggagcagcaggtgaggcaggagcagcaggtgaggcaggaggtgcaggtgaggcaggaggtgcaggtgaggcaggaggtgcaggtgaggaaggaggtacaggtgaggaaggaggtgcaggtgaggcaggaggcgcaggtgaggaaggaggtgaagatgaggcaggagctgcaggtgaggcagtaggtgcaggtgtggtggaggcctggacccagtcatggcgccagaccctgcggcctctggtgaaaactatggcctaccgggaactgagacccttttccgggagggagcagccaggctgcgtggaagagtcctttgagagctggttggaggacgccaaggatatgctgcagctgtggtgccacgcgtcggaaagggagagaaggaggcggctgctggacagcttggatggcctggccctggatatcgtgagcggcctcctggaggaagatccagacttctctgcgcaggactgcctgacggcgctggggcaggtgtttaggagccgggatacatggatgacctcgcggatgaagttcctgacctgcacgcaggggccccaggaggggctgtttgccttcgtggtgcgcctggaaggcctgctgcagaaggccgtggagaagggggcggtccacccagccatggccaaccacctgcgactgcggcaggtgctgtctcgggcccgccccagcgaggcactccaggataccctgaggaggatgcagctggagaggaggccacctgacttcctgaggctgctgcggctcatccgggacatggaggcgtgggcagcctccctagcaaggagccagcagggtgtggcctgggcagcggccccagtggagagtgaagacccagctgctgcccaggcctccccggcccagggggacgccagcgaggctgatcccggagcagaagatgctgatgaggctgcttccaccaccaaagaggccgccagggttgcccctgccactggggaagatgaaaatgcccctgcaggccttgaaggcctaggtcagggaaggtcccccgacgcccctgggggcctcccagccaggatgggcagtgcagtcgacatggccccaggaggtcccagctgggagccagagggccttgtccaggttggaggccaggaggctgaggagcctccccaggaggggctcaagcccatcttagaggagtcagaaaacgaggatgaggatggggctggggaggcgggcaagcccaagtcccccccgggcaaataggctctgagggccctgagggctcctctcctctcaggcagcagcaccctggaggcagacagaggccaggccagggccggtccctcaccccatgttgggagctgtgcctcccacctcccctaatgggtcctggccaccaccaccagcccttcccagtgactcagatgaccacgtttgataccaaatggggagctggcctggagggagctctgagcggccagcctgaagatgtctgccccccaccccttgtcctgtgttgggagagatgggggaaagaggccctctcaagggtgacagctgcctacatgtcccaagaggtggcccccacttgccatccctggggcagactgccccccgttccgggaagcccaccctcacctctgtaggccccatagtgacccacgcgtccgaacagcagacgcccactcacccaccgctagccattgttcctacacaaagttgtatgctgtgcgcccatcggtgcggctgcctctgggcctggggcacatgctgtgagcttcctgctagcccaggctctgctagctgctacctgtcccttgtcgtgagcaccacctctgctttcctggtgtagatctaggccaggggctgcttgttctcgtggagctgtgtgtgttcttctctgagcagctcctccccggaggcccccagcacagtcctgggagatggtggaaggaggcgccagggcacgatggacgctcatcctgtgactgctatggtgagcatgaccacgatggtgcccgtgaccatgatggtgaccatgactgtgtgaggaagaaccggacctgggacagagcagagctgccctgcctgaggctccccggggagctttgtgctttggtgttctattcctgttgttacttgtgactcagtttccttgacttgggggggtgttccctgctgtgttttcagtgtcctgtgagggctatagggcagggccctgccccagcggatgggctcgggagggggctccctgaagccagtggacactgccagagtccaccatcctggcaagaggcggaccctggggccctcaggaaggagggagttggcagcgggggctgcagcaggagtaggagcagatgaggcgtcttgccaggaaccccaggaggagggggcccgggacctgtgtgggacctgtgtcctgtggtggcaatttgcagtttctctctgtgttgtgattcccttctcttcaatggtttcagtacatgtttctcttcaataaacttcattcagtgttcc

SEQ ID NO: 149576 - DNA, 1268 bp, Homo sapiens
  Payload ID: 9538
  Gene Symbol:
  Gene Name: LLfos-48D6.2
  ENST ID: ENST00000621615
  CDS Start-End: 75-467
gcgaacggcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtaagtgctgcttcccccgggccccggcgggcagcggagtcctcgggtgcaccagggctcctggggccctgactccctgccctccctggaggccgccccagcctggagctgcttcagcaccgcgtgatgaagagccctggccccgggctgctctgaca

SEQ ID NO: 149577 - DNA, 7746 bp, Homo sapiens
  Payload ID: 9539
  Gene Symbol: LLPH
  Gene Name: LLP homolog, long-term synaptic facilitation (Aplysia)
  Uniprot ID: Q9BRT6
  ENST ID: ENST00000266604
  CDS Start-End: 72-461
ggaagacggaagtgcaaagacttccggtcggcgtgagcgtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaaaatacaaaattagccgggcatgggggcgcgcacctgtagttccagctactcgggaggctgaggcaggataattgcttgaacccaggagatggaggttgcagtgagccaagattgccccactgcactccaccctgggcaatggagtaggactctgtctcaaaaaaaaaaaaaataatggatcttataaagtacttgtgtggagctttgattccacagaataaaagatattttgtgtgtagatcttcaagtctgatttttttttctttcatgtatgcttaaggttttttagtcctagagaagaccagatttcaattaaatgttttcttatcttaattttaggtagaatattaacatatacaaatcagtatgctttttaggaaattagaacatttcaggtttttcatggaaactgatttaatgttctttagtgttaatattgtgtggcctaatatagtatcatgcagcattccccggagtgtgttcttcagtatcagtttcctctggatgcttggttaaaaaaaataaattgtgttcacatcgatttgggaaatgctacatacttgaagatttacaaaagattttagtttaggattagaatagtcctacagggttccagcagcaaagaaacctgtttagcgtctactctttgaaactagttttctgagaaatgatttttagttaaatctgtcttactacagtttgctaaattcatttttattttacttttagttaagcaatctaaacttagcattccctctgaatttcactataatcagattaaccatctcatatgttaactggaacaaccaaatacttactgagtgcctagtatgtgggccagggactttccagatgcttgggacagattgaataagataagatttctgctctcatagggctgagagctgtgtatctgtttagaagaagatgttaacttcccaggagaactcaagtaaaatgtgaaatagaataaggccacttggtcatgaggtcacaaactttgtgccaggcacactgctaaattggggcacaatacatggacatgtattgtaataaagaggacatgacccaaatgtttcagaaaatttaagcttataaaatttgatgccagtaaactcttggaattgtttaaatatagtagacttttcttatttttctcaatagtttattgaaaagttggtagataactttaaatgcttaaaatttcttaacagctaagaaagatatgaattgaaagatgtcattcatgatctttgttgcctttggtgtaggtatgaataacactagcatttgtgagggaaaagtgaatatgtacatttttattcataaaataaaaaaaattgcaaacaaccagttaagccactgacaatatcagcctaaatacagtagctgaattatttatgttttttttttttttttttttgagatggggtctcactctgtcacccaggctggagtgattggcacaagtgtggctccgctgcaacctccacctcccaggctgaagcgattctcccacctcagcctccccagtagctgggactacaggtgggtgccaccacgcccagctaatttttgtatttttgtagagacagggtttcgccatgttgcccaggctggtctcaaactcctggactcaagtaatccacctgccccagcctcccaaagtggtgggattacatgcgtgagccaccacacccggcctaatgtagacattttttatgatttttggaaaagggggccaggcaccaaattctaacaatttgggaggctgaggcagatggatcacctgaggtcaggagtttgagaccagcctgaccaacatggtgaaaccctgtctctactaaaaatacaaagttagctgggcatggtggcaggtgcctgtaatcccagctacttgggaggctgaggaaggagaatcgcttgaacctgggaggcagaggttgcagtgagtcaagaccacaccattgcactccagcctgagcaagaagagcgaaactccatctcaaaaaaaaaaaaaaaaaaagtctacattcgtgatattacacagttggcacttatttacattttggcagcattgtcaggtagagaccaatgccagggttatgttcatgttttctgtggctgataacctctaatttgattctgttgatagtagctttgagctttcatccagagcctctctgatgttaggattttcacttcattgtgtccagtcatgaagtttgtccattcaggatttaacttgaaagttaacaaaatcaaaaatcaaagcaccattaccagaaaacatatttgggaatcatgttctcaagtgtcacatggcctctggaaaggcgactgctgaagagaagtttactgacacagtgttgtcagtaccctctaaggcactgagttcctgaacactaccagcaagattctccccacctccaaatattggcaggaaatttagactagcatttcaaaattagtgcaggggtatggtcacatctttggcactttatttttaaagattacaaatcgagaagtatagcatagtccttttatcttttaaataattagcttatttttttgaaatttgtcatctttttgactgacattttccagagaattgctgtaaagccacaagatggagctcaagctaagcaccaaatcattttggaattagattgagtgagctaaatcacattaggaattgaatgtaacactttttgtgttttaagaaattaagtctgaaatcaaaatataatttaaagatgatcaaaactgcttcaagtattaactcatttaatctgcccagcaatctcatgagtttggtactaatgttatctgagtttggtactaatgtaatctctgtttacacatggggaaactgaggcacacaggccatacaactaaaactgaaatctgggattcaaatttaggcagtgtggctctagagcctatactcttacaatgccattctgcctctcaaggatgtgcaaactcttgctaagagagaaaggtgattttaggatagaatacctatttttgggtcaacctgtgatagattgggttcatgtgggctcaggatcagataaagagcaggtttaagtagaataatgatgtacagaaccctcctcaaatctctaggcctaaggcagactggatttcctcaggtgacacttcattaggaatgggctgaccaatccaaaaggggaaggtgtaggccatgatcagtagttgcccaaggtactaatcagagaagaaatgcaaactgcagttgaagctctaaggtagaatcaagtagtggttttgaccacatcctattttctactgtcacattagtgtagatatctcttcccactatgtaattcacatgctacatcaaataaggatgcagcagtatatatttgcttattaggaaattcagatattttcaaaatttggatccgtgtttctggaatatggcttaagagttggagaagaaaaatagctataaatgacttgaatcaaatatctgaaatggactggtggtgatggtgaggggcagcaatgtgtaatttagggaagtgctgaccacaacataaaattgggaggaatctaaggcattgccaaatttataaatactacaatagaaatgcagatgctaagctgttggctaatcttactagttaagtgactaacttctgatgccatctggcagagtgattcaaatttgtgctaaacacaaaatatatgtctttttccctctatttgcctgcatgtattaataaaaacactgttgcagtagacacataccaattttacaaggaaatgtttaggggtgaggtgggactgttaaatacttacatcaggtcaaaggtcactctgctgtttccagaggactgtcaggtagccaggaggcccagggccacttttgggcctgcttacaaaaccctaaattttccgcagttgaatgccaagagtcttttgcagttattttagagcaggggagaaaatacaatgtgttgccaaataagcttaatttggtaggcaagcagtaaaaataacccaacagccaacatttagagaatgcgtactctcttaaatgctttatgtatattatttaatctttaaaacactgtgggatcaatactttaattatccctattttcagatgagaaaacagtttgaaaggttaactaaatttacccaaagtcatgcaactgctaagtagtgagcaagccgcctgtcccagagtatagaatgaatacctatgatggaaagctacagagagacagacttttatttgatttaaggaagcgccttctaaccaagattttgggagctgaaatgggcaccttgggatccttgaggtgtcagtctaaggtggacaggcatttggttggaatgtagcaaaatggattcaaacactgtagagttatccttcagaatctatcggggattggtgccaggatcttcacagataccaaaatccacagatgctcgaatcgcttacataaactggtgaaatatttgcatataacccatgcccatcctcccatatatagtcatatgtcactaaatgactgggatgtgttctgagaagtgtgtcactaggtaatatcgttaatcattgtgtgaatatcatagactgtacttacacaaatctagagggtatcgtctactacacttaggctatgtgatatagcctattgcttctaggctacaaattggtcaagcaagttactgtactgagtactgtaggcaattgtatcacaatgggaagtatttgtgtatctaaacatagaaaaggtacagtaaaaatacagtataaaagataaaaaaatggtacacctgtaccacttatgaatagtgcttggaggactcgtgcttggggtgagtcaatgagtaagccatgagtgaatgtgaaggcctcagacatgactgtatactgctgtatattttttttttttttttttgagacggagtttcactcttgttgcccaggctggagtacaatggcgcaatctcagctcacctcaacctccacctcctgggttcaagcaattcttctgcctcaacctcccgactagctaggattacaggcatgcaccaccacggccggctaattttgtatttttggtagagatgaggtttctccatgttggtcaggctggccttgaactcctgacctcaggtgatccacctgcctcagcctcccaaagtgctgcgattacaggcgtgagccactgtactcggcctgctgtaggctttatatacactgtgcacttaggctacataaacttataaaaaactttcttcaataataaattaactttagcttcctgtaacttttttaccttataaacgttttaattttttaaactgtataacccttttatcataacacttaccttaaaacacaaatacattgtacaactgtacacaaatattttatatttttataagcttttttctatttccacaatttttaattttttaatttctttttttacttcttaagtttttttgttaaaaactaagacacaaacacattagcctccatctacactgtcttccacctccacagcttgtcccactgcaaggccttcaggggcaataacaggcatggagttgccatctcctatgagagcaacaccttcttgtgcaataccttctggaggacctgcctgaggctgttcacagtcaactttttctttaagtagaaggagtacactctaaaataaaaagtatagtaaagccataaaccgtagtcattattatcaagtattatgaactgtacataattgtatgtgctatacctttatatgactgacagcacagtaggtttgtttacaccagcatcaccacaaacacgtgagtaatgcattgcactgtgatgttaagatggctacagtgtcactgggccataggaatgtttcagctctactgtaatcttatgggaccactgcctatattgactgaaatgtcatcatgcaatgcatgactgtactttaaatcatctctagattacttataatacaatgaaaatgctatgtaaatagttgttatactgtatttagggaataatgataagaaaaaaagtcggtacatgttcagtacagatgcaactgtagttttcttttgaatattttttatctcaggacgaagccccaaatgcagaattcatagatacagagggccaactgttcttggaatttgggttgaaagctgttaaagttcttttcagccaaaaaaaaatgcctcgtaataaattgtcatgtttgaaatgtatcatgcttgttttgctctacatagttttttggtactacataactgtagacttaagtatctttttggtggaaataaaatatgaaatctctttaattttgttaatgttaggtctggtattcgttccattaagttccactttaaagtatggaaaaatgttataaacatctgctttaaacaatgaatggtactgcaatagtcctgtaaagaaaaatgaatggagtaaagtccttcaagttttcatttaaagaatggcatagctttataatacattaagtttttaatatgcggaatgtatttaatatcctaaagcgatgaattgtcttggcattatgctatcttatgaaacactttcttactctcacattgtgtctttatagttttcaatatcagcaaaacctttaaatagtcttagttgggtgttgtgtatcattgtacagcaactgttagtacatgtggtatttctgatccatgtaataaagtacatttgtcatgta

SEQ ID NO: 149578 - DNA, 1177 bp, Homo sapiens
  Payload ID: 9539
  Gene Symbol: LLPH
  Gene Name: LLP homolog, long-term synaptic facilitation (Aplysia)
  Uniprot ID: Q9BRT6
  ENST ID: ENST00000446587
  CDS Start-End: 255-644
gagttcggttcctcaccggtccagtgacacatgggacttggggcttgattccgccacccttggagaatttcgtttcttgacactcgctgggctatacttgagctccagtccggagatgcaggccttgttgagggcgagggttccccttgctctttttggtgggggccctccggcttccgagtgcactggataaagtggagcccacccctgtcgttcactcccgctgaagttaacttcggccctcaaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccaccaaatgaaaaccatttgttttcctattttaacttggccttttttcttcaattcaaacccagcataactcctcaagtttgttttgggaacttgaataaaatattttctttgatacatccaagctctactgatactttaactggatgctacccaatatccagttataatcaggcctcaacgttctgtcaggtattaatatggttagaattgttcttacaactggtaattatagtcaatagagataaaacagatgatgtactgacaaatttttgtgaacttagattttaaagaaagttgttgtataatcatatcatttaaaaatactacattagggctgggcatggtggctcacacctgtaatcccagcactttgggaggccgaggcaggtggatcacgaggtcagttcgagactagcctggctaatacagtgaaaccccatctctactaaa

SEQ ID NO: 149579 - DNA, 2099 bp, Homo sapiens
  Payload ID: 9540
  Gene Symbol: LMBRD1
  Gene Name: LMBR1 domain containing 1
  Uniprot ID: Q9NUN5
  ENST ID: ENST00000370570
  CDS Start-End: 344-1747
gtactgcattcatgaagtaggctttgaaaattatacatcttggacaagtttttaagggatagtgggctttccttacacaactaaaataacctttacttcacataaggtttcctgctagaaactttcaaacacatacaaaaatcagagaaaatacactgggtagtaacaaacatctctttttgttctatttcaggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatctgtatctgtgc

SEQ ID NO: 149580 - DNA, 2209 bp, Homo sapiens
  Payload ID: 9540
  Gene Symbol: LMBRD1
  Gene Name: LMBR1 domain containing 1
  Uniprot ID: Q9NUN5
  ENST ID: ENST00000370577
  CDS Start-End: 231-1853
actgcgtccgcacgcgccccgcccctgagcagtccttgctgccccgcccccgctcggctcgccgccaggggacgctagtgggtccagtctccttggcaaccacttgctcctccccctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatctgtatctgtgcctta

SEQ ID NO: 149581 - DNA, 1861 bp, Homo sapiens
  Payload ID: 9540
  Gene Symbol: LMBRD1
  Gene Name: LMBR1 domain containing 1
  Uniprot ID: Q9NUN5
  ENST ID: ENST00000472827
  CDS Start-End: 5-1183
gaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagaattcgaaatattggcatatggttcttttggattagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaa

SEQ ID NO: 149582 - DNA, 8185 bp, Homo sapiens
  Payload ID: 9541
  Gene Symbol: LMBRD2
  Gene Name: LMBR1 domain containing 2
  Uniprot ID: Q68DH5
  ENST ID: ENST00000296603
  CDS Start-End: 464-2551
acaaccccccgcgggagcgggactggtcggcccacggggtaggcggggaggcggaagcgggcggcgctacggctgactgggaaatgtcagccgctggactgtagacggattttcctttctcgggagcccgcaggccttctggtgatcgccagcgctgtcgtctctgagcgtggatcccagaacctggacagctgtggcggccgccgtttcccggtcccgtccagacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccagatatggtccagacctgtacatgaataactttggttagtcagagtgaaatattcaataatgagtggtgcagctttgggacttgagattgtttttgtcttttttctggcattatttctgcttcatcgatatggagactttaagaaacagcatagacttgtgattattggaacactgcttgcttggtatctctgctttcttattgtcttcatactgcctctggatgttagtacgacaatatacaaccggtgcaagcatgctgctgcaaattcaagccctcctgagaatagcaacattacaggattgtacgcaactgctaaccctgttccaagccagcatccttgtttcaagccatggagttacattcctgatggaatcatgccaattttctggagggtagtgtattggacgtcacaatttttaacatggattctcttaccttttatgcagtcatatgcaagatcaggagggttttccatcactggaaagatcaaaactgcactaattgagaatgcaatctactatggcacctatttgctgatttttggagcatttttaatttatgtagctgtaaacccacatttacatttagaatggaaccagcttcagacaattgggatagctgctgcaaatacatggggtctgtttcttcttgtgttgttgttggggtatggcttggtggaaattcctcgatcatactggaatggagcaaaaaggggttatctacttatgaaaacgtattttaaggcagccaaactgatgacagagaaagcagatgcagaagagaatttggaagatgccatggaggaggttcgtaaagtgaatgaaagcatcaagtataatcacccattgagaaaatgtgttgatacaatacttaaaaagtgccctacagagtatcaggaaaaaatgggtaggaacatggatgattatgaagattttgatgaaaagcatagtatctatccaagtgaaaaaagtctggtaaaactgcataaacaggtgatttattcagttcagagacaccgtcgaactcaagtacaatggcagattcttttggaacaagcattttatctagaagatgtagcaaaaaatgaaactagtgctactcatcagtttgttcacacctttcaatcgccagagccagaaaatcgatttatccaatatttttataatcctacatttgaatggtactgggaatgtcttttgcgaccatggttttacaagatacttgctgtggttctgtccatcttctctgtgattgttgtgtggtcagagtgcacattctttagcactactcctgtcttatccctctttgcggtcttcatacagctggcagaaaaaacatataattatatttatatcgagattgcctgcttcctttccatcttcttcctaagtatctgtgtttattctactgtgttcaggattcgtgtatttaactattattatttggcctcacatcaccagactgatgcttatagccttcttttcagtggcatgctattttgccgtttgacacctcctttatgtcttaatttcttgggtttgacccatatggattcatctatctctcacaagaatactcaaccaactgcttatacatctattatgggttccatgaaagttttatcctttattgcagatggattctatatatattatcctatgttggtggtaattctctgcattgctacttattttagtttgggaacccgttgtttgaatctgctcggtttccagcagtttatgggagatgatgatatgacatcagacttagttaatgaaggaaaagaattaatcagaaaagagaagagaaaaaggcaaaggcaagaagaaggtgaaaatcgaagaagagaatggaaagaacgttatggacacaatagagaagattccactaggaacagaaatattcatactgaccccaaagagtcaaacttctcagatgttaataccaaccgttctgcattcaaatataccagggctaataacaggactgaaagggaccggatagaacttctccaagatgcagaacctttggattttaatgcagaaacattcactgatgatcctcttgaatctgaatcaggaaggtatcagcctggtggacgatatctctcgatgtctcgcagtgacatatttaatgatgtttaaagtctgaaaaagtttgtgggaccactaaccaaggtcaacacatcagttcagtcttgatgaacatctgtgtaccctagaatttcctctatacacagtgaaaagtgtcaagataacaaaaaaggcactgagaattaattatatcttaggaataatagtttaatgtgcattgaatagagtatcacctttttcaacaagatttattacatatcatttcctaagcatctgccttagaaatacagttacagtggaaggactttaagaaagatcaacatatgttaagaacatgcagttcagtttgtttcagattaattttttttcaagagagttattttaaagattcaaggaagccataagtcatactaaataatattatatacagttttgttattgtgacttacatttttgttacttctaaaaagtatattcaacctgtatttcccaaagaaatgtaagtgaatggagacctcaaataataactgtattcataaaactcgtgtcttaaaacaaggcttacttactagacataactgaatgtaaaaagtgctttttcaaatctgtttgcaaactcgtgggggatttttgcatgtataagattaagattatacttcaagtgatgcgtgtctgtgtatttagcatgtgtactataatcaggtgatatagtattccttcagtctttgtagtaactggatttttttatgcttctggtattgctttataaaagattttcatttcagaaagctatgttcacatttatcatttaacatattgatttaaatgttgattatgatattcaaggataaatcctaggcattaatgaaaaatagtttttttttaagtagtcaaagagtccaacaaaatccttcagtatttaaaggtacctgcttatactttttgagaaaaaaactggttattcaaaggtaaaaagtgaatccatttactgttattactgatacttaaatcgtggtttatagaaaacaaaactatattagaatggaaatgtgtaataacttgttggttaaacattcttactaaatagactgtttttaacctttgtgtttaagataaatttatgtattatattttaaagcactagtgttttattgaaaagtgaacatgtttgattgcagcatgcttgcagagagttttcttatgtccctagaatatttgcaactcttactgaatccatgctacatttggtgaccatacttcagcttgcctaatacagtctcagtgtaacacctagtatcctgtttattactagtgattactttcaccctcaagtatcccacccagtttgaagatgaattatatggttcccctaacttgaagttaatctttccccaagacataaatttaaaatttttatttttatttttaataaatattatcatgtaagtttttttttaaaacacagctctatgcagatattgaaaggaatagagcatcatcctcattatctgaaaattttgatctttgagtttttatgatctttgcaattagatcccttttaaaataattatcagtggatagacttactctgaattgaaggtcatatagactacacttaagaacacacacatacagtcttttcatgtgaagtgtggccagaaagcaataagccaggagcagagataatttgatcctctttgtaatttaatgattgactaattgaatacctttggcaaatcatgtagctcttcagtgcctcaagtgcttcattctgcactttcatttgcagaatgaagatgatacttgctatttacctgctgatctaccttacaaagccattgtgaggaagttgaattggtgtttatgtactggagtttataactgtgctatttttcctagtgatacttgaaggtattggatggggaaatgatcatcccagaaatgggtccagtttcttattattacagaaaagtttacaagtacttaaagcaaaaacgcttttggactaattcatcaaaagtcctgtgaaagtagtgttgttttatttagtctttgggtttactttggaataatttcttaagtataatgtttctcatcaggttttgtcatgaaattaagatgctgttgttgaaacagaagcagaaaaggaaaagaaattagccaattacttttataactaacttttataatgccctaagataaattggtaggaacgtgtaaggtaatgttaccactttcctttagtattaaattttttatggttataataattgaagtgtatacgtgcatacacttcacaaccggtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtttattgctggggaaccaagttaatatttgtcaagccaccctgtgtaaaaaactgtaatgggtagaagttttctcttttgagaagcttattgaaatataatgacatctactgcaaaataggactactaaatacatatactttacatgcaaagtacatttcttaaagaattatttctggtaatttttgatgactttattacttgataataagtattagtttaaaattttccaaattattctttaaatagttgttaggtaagaatattcagtaagccagtaattcagaataactattgtagaaaataataataatctattaatttaatgaatcacctctaaattactaattaacttcttttacaacataaataacttgttatcaatagagcatttttgtaaaaaacaaaagaaagaataagtttaattattaaaatttgctctcttaccaaatgaatacaagggcttttgaataatctcattgcataagaggccctcatttcacagaaatggtaagaactaaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggccttctaaaatatgaattcccatctgtatgaggtacttctttccaactcagtgactttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatatgtaatgacaaatgttttactatctgatcattgggttgtagattaaactattttttttctctgtagattctcactacattttcaaatatgtacttggaaaaagctgcaaagtgctacctataagcaaattagtaactttggccttatctatgcatagtgttcgctcagtttggttttgataaattgattgacttgcagttcctttgtagtattttaacttattgtgatgtaatgaattttttgaaatgtttatttgattagctgttaaaatataggaaagaatgtagctttgcatgaaataaattacatttctacaagttaataagaattttgctgattgtttatatattttacttcatttgagattaaggttcttttaagtagattcaggcgttctttgttccttatcaatttattagcaaatatgacaaatgttttaaaataaatatgtgtactttagttttca

SEQ ID NO: 149583 - DNA, 1167 bp, Homo sapiens
  Payload ID: 9542
  Gene Symbol: LMO7DN
  Gene Name: LMO7 downstream neighbor
  Uniprot ID: F2Z398
  ENST ID: ENST00000318245
  CDS Start-End: 90-458
ttttattctttttagatgattatcccggggctcctctgagaaaagtaggagtagattgctggaattaccatgggttaaaatgaaagaggatgacctggctggacaaaggcgtatggactcaggaagacgagaactcctgctccttctctgaatcggattttcctggctgtagagaccagatcaacccttccattccatcgatttggaccgcagtttcgggaatgatgatttcgctggaagtgcggtggtggataaaggggaagcagggttacgtaatttcactgggtcacgctctgtcacctaggctggagtgcagtggaacattctcagctcactgcatcctcggcctcccagggggctcaagctatcctcccgcctcagtctcccaagtagttgggaccacagctttgtatctggtggaggaggcttgggccgaagctggtaaaatgagaagttaggggaggatgtcctcagagagctggaagatcacagtcctcattgtcacaaccgatacagtgttgatagggacaacatatgccttggaatgtttcaaatactttgccacaattaagggacactgaacaggaactcagttttggaaaacaaagtggaatttctggaaactgctagcataaaagctttgacagggtcacatgcagattagcataattttattacattttctattttagtcctgtgagatactaatttggatttcattgtgcccattgagcggcttttgttctttggctgtgagtttaattatttagttatttatgagtgcatctgggcataagtgccacagttttatttcggtgacaaatttatggtcagtgaattttagtaattaatgaataaattatttctcctccataaatgcccctgcaatttctgattttcataacaattcataatacttaagaaaaattctttattagttgaaaaagccaatgctaatggaatcaggaaaaggagatttcaaattgctttaattaactgtattaattaatatccaatatgtgtaagatattgaattggctttggttgtctctcttagcatttagttgcctaaaatctgtttaacatatgaatatactgtgttaaaataaattctaattcttttgtgaagtaaatggcaagaataaaaggatctcctttataatcttt

SEQ ID NO: 149584 - DNA, 3236 bp, Homo sapiens
  Payload ID: 9543
  Gene Symbol: LONP1
  Gene Name: lon peptidase 1, mitochondrial
  Uniprot ID: P36776
  ENST ID: ENST00000360614
  CDS Start-End: 159-3038
cgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagta

SEQ ID NO: 149585 - DNA, 3002 bp, Homo sapiens
  Payload ID: 9543
  Gene Symbol: LONP1
  Gene Name: lon peptidase 1, mitochondrial
  Uniprot ID: P36776
  ENST ID: ENST00000540670
  CDS Start-End: 514-2805
agacgaatcccgggaagcccgaatccgcgcaccccaaagtgcgctcagagcctgagtatgcgcacccggccacccgtggccagtctagagtctgagcatgcgcatgttgtccgcgcgcctaagcatgtgcacaggctgctcatgagttcctaaacgttgcgtttgcaacactaccagtgttttgtacgggcgctggcgcctgctcacagccttccacgtgaccggaaaaggccttcagcgcataaagtgggagaccggaagaggcggagacgatccgatgctcgaactccgccccctcttctccgcgtaggcccagctccctgaagcggctgtttcgagccacgcgcccatcgggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 149586 - DNA, 2626 bp, Homo sapiens
  Payload ID: 9543
  Gene Symbol: LONP1
  Gene Name: lon peptidase 1, mitochondrial
  ENST ID: ENST00000590729
  CDS Start-End: 60-2549
gcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccg

SEQ ID NO: 149587 - DNA, 2882 bp, Homo sapiens
  Payload ID: 9543
  Gene Symbol: LONP1
  Gene Name: lon peptidase 1, mitochondrial
  ENST ID: ENST00000585374
  CDS Start-End: 148-2685
agtatggccgggctatggcggcgagcactggctacgtgcgactgtggggagcggcgcggtgctgggtgctgcggcggccgatgctggccgccgccggggggcggcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 149588 - DNA, 2884 bp, Homo sapiens
  Payload ID: 9543
  Gene Symbol: LONP1
  Gene Name: lon peptidase 1, mitochondrial
  ENST ID: ENST00000590558
  CDS Start-End: 1-558
ggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagggaggcctcagccgggtccagctcccagcctcagcggctgattcacacctgccttgctcccgtgtcagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 149589 - DNA, 725 bp, Homo sapiens
  Payload ID: 9543
  Gene Symbol: LONP1
  Gene Name: lon peptidase 1, mitochondrial
  ENST ID: ENST00000590206
  CDS Start-End: 1-725
gatgatgcaggctggccagcgggtggtggacaaccccatctacctgagcgacatgggcgccgcgctcaccggggccgagtcccatgagctgcaggacgtcctggaagagaccaatgtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccc

SEQ ID NO: 149590 - DNA, 641 bp, Homo sapiens
  Payload ID: 9543
  Gene Symbol: LONP1
  Gene Name: lon peptidase 1, mitochondrial
  ENST ID: ENST00000587365
  CDS Start-End: 12-641
atggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggtggaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactaccta

SEQ ID NO: 149591 - DNA, 793 bp, Homo sapiens
  Payload ID: 9543
  Gene Symbol: LONP1
  Gene Name: lon peptidase 1, mitochondrial
  ENST ID: ENST00000589473
  CDS Start-End: 1-793
cggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggcccaggcagggctgaccctgactctgcccccaggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccct

SEQ ID NO: 149592 - DNA, 471 bp, Homo sapiens
  Payload ID: 9543
  Gene Symbol: LONP1
  Gene Name: lon peptidase 1, mitochondrial
  ENST ID: ENST00000586617
  CDS Start-End: 15-275
agtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcggggaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgca

SEQ ID NO: 149593 - DNA, 2918 bp, Homo sapiens
  Payload ID: 9543
  Gene Symbol: LONP1
  Gene Name: lon peptidase 1, mitochondrial
  Uniprot ID: P36776
  ENST ID: ENST00000593119
  CDS Start-End: 34-2721
gcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagt

SEQ ID NO: 149594 - DNA, 8199 bp, Homo sapiens
  Payload ID: 9544
  Gene Symbol: LONP2
  Gene Name: lon peptidase 2, peroxisomal
  Uniprot ID: Q86WA8
  ENST ID: ENST00000285737
  CDS Start-End: 94-2652
aggcgggtctgaggtttggtgactgcggggcaggccgggggcagctgtctgtctggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtacctggtaacttgttagaaatgtacattctcaggctccacagcaggccgcctgaatcaaatcctgggaggtggggacagaaatctgtgttttaagaagccttccaggtaattctgctgcacactcaagttcaggaaccaccggtatagaccattaccttagtggatttacctgtagagtttattggatcctgaaaccaatcaattacttagaactaggcaaagatgaaagtatagccaactattcttggctatatatatatattcaagtgggccgggcgtgatggctcacacctgtaattccagcactttgggaggtcgaggtaggcagatcaccgagcccaagagttcaagacaatcctggccaacggcgaaactctgtctctacaaaaaatatacaggcgtgttagcatgtgcctgtaatcccagcttcttgggaagctgaggcacaagaattgcctgaacccaggaggtggaggttgcagtgagctgggatcgcgccattgcactccagcctggctgacagagcgagactgtctctaaaaaaaaaagactcaagtggaccctacaatgaagcctacacatcccaatagaagccccttcttatgctgagggaagcagccctcagaacatgatagcttgtatccagcagagtggcacgtgctggcacacctcacagaagcaccctggccctggatgcctgcaacctcagaagagtgcagctcccagagggaggcagccatccatctgggatggtcctaagcatggaatcctaactcctgattccgtctcctatttcttgcttggctacgccagttcccaaatctggtagatgtccatgcccatgtgctcctgctgggactcaattcaggctatgtatgactatgaagtcaggctcatctgcttactggctgtgtgaactttttgtatcttggttttcttcatccatgaaatccaagtaatactacctaattgttactgtggagattaagttcaaatgcaatgtatagtaatattaagcaatttctagttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgttttttttttaattccaggggtgggaggttggttggttgaagtctaagctcttcctttttcacctgggttttttttttttggggggggtggggggttaggggtggggcgggtggggaagagccaaaattttaaccatttttaagcatataatttgggggtatcagttactggatctaagcatgtccactctacacgctttttttttttttttttttttttttttttgagatggagtcttgctctgttacccaggctgcactgcagtggcatgatctcggctcactgcaacctctgcctccccagttcaagcaattctcatgcctcagcctcccaagtagctgggaccacaggtgtgtgccaccacgcccagctaatttttgtattttttagtagagacagggtttcaccatgttggccaggctggtctcaaactcccaacctcaaatgatccggccaccttggcctcccaaaatgctggcattacaggcgtgagccaccacacccggcttacatgcattttttatcaccacaaactgaaactctgtacccactgaaaaagagctccaaattccaccctcaccccagaccctggtaaccactatttcactttctttctgaatttcccttcatatgagtgggatcaaacaagagttgtccttttgtgtttagcattcttacttagcaagccatcaactgctcgaacagtcactggggcaactacttttcgcccagtgtcctccagaaaagaaagatctggagggtcaggccactctttttcttcaaaataatggggtgcagaagggtagggatgaacctcttcctcctttgccactttagctttagctcaaaggaactccaactttttattatttgcaacagttagctttctttgtttcacatctctgccttgcagaaccatgacctatcaaggtgttttgtcaaacaaaaactaatactttccctgggaaaaagccatgtggtagcaagtaccagaaatttttatggccaaataatacaccactatatccatagaccgcatttggtttatccactcatctgctgattgtttccccctcttgggtattatgagtaatgctatgaacatgggtgtacacatctctcttgaagtcccttcttaggtcctttagggatacatatccaggagcagaactactagatcacatatgctaaggtctgaatgtccccccaccaaattcgtatgttgaagcaaccaccaacgtgataggtgaggctttaggaggtgattatgtcatgagagctccatcctcattaatggatttagtgcctttataaaggggctcaagggaaccaattacctcctttttgcccttcgattcccttccaccatatgaggacacagcaacaggccccgtcctagaagctgagactgggccctcaatagatgataccagtctgccagcacgctgatcgtgggcttctcagtcttcacaactatgagaaataaattcgtacttttaaattacccagtctcaggtattctgttacggttaacacaaatgactaagacaacaggataattctgtttaactttttgagaactgccaaacttttccaccgcagctgcaccatttgacattccttccagcaatgcacaaatgttccagtttctccacatccttgccagcactcattttctgggttttttataatagccctccaaatgggtgtgacgtattttgattctatgtccctaatgactagtgatgttgagcattttctagcattgatttttaagatgttacccaaagaccccttgtatcaaaataagctggatttttttattgaaaattattaactctagaaattttagtttaaactagacttagggatatgtgtattttaccggtattccacgttttatgcatgggtttttaaaacttctcaagtattaaaactaaaagctttaggtgctttgcttatcaagaaatcctacactgtccactggagacatccatgtttttacttggctctgcccctttagtggtccctgtgaaccttacctcaaaccatgcatctggggcagagatccttacttgcttggtggttacaaatgcaaatacagtgaagaatgtcatctttgtgattgttcctgaaatagttcacgagaaatccatgaccgtaaagtactgtgatagtgatgtctaccactgtgagcttccagtactaggtgattggtctgcattcacagtgaccaaaatcagctatgtggccaggtaattcactgctgagggctttggattttcctttatgaactactgaaatgaggtcaacttgactattactaagggacattttgctacaaagaatgttagttttgccaattccctttccaaatctaaaatttattttaaccaggattttagatgtaaacatcaagtagttttggttgtttcaatgaagtaacatgtttaagctcacattatttgaagtacttcagttcctattgccatgaaaattgtatccagcagctaaaaaaaaaaaaaaaaaaaaagactacagttagtcattatccaatttgatgatttatggtccaacactaatgctcattttttttgtttgttttacaaacatttggtggataccacaatgaaaactgcacttaaaaaacaaaaatgctgaaagaggaaggaaatatcaaaaaggtctgaatagacaacaggcaaatatggtgagtggtcattgagatgttttaaaagttacagcaaaaggacttctaaaacaattttaggaaaagctttgtcatgaaaattcatttctttggaaatactgtagtttgtacttaatgacactgtcagcacatttctaggcaatacaaactcttgaggctaaatcctcatcctgacatgacagtgcaagcctgtcaaaatgtgaccccaaaaccaggtgtccttttgctccattatttatatctgtaaacctgttattattttcagaattcagaaaggcctaagaaaattacatctatgataataaagtgtatttctttgtcaagtttctagagctatataaggatagcgaaaatatttggttcagcaagacactggggtatcaagtcaggcataataagcactttatagcacatctagccttcctcattcccttacgcagtggacatcatacccttttgtggaggagggaccaggcagagaaggtatttaaataaaaactggtagatacagagtcagaagtcaacccaggcagttagaatctacaacccacactgtttgccaccaaatcttagtagatgcttgataaggaattttgtttggatggtgccatttttagataaacgtacgtttcttttggt

SEQ ID NO: 149595 - DNA, 2056 bp, Homo sapiens
  Payload ID: 9544
  Gene Symbol: LONP2
  Gene Name: lon peptidase 2, peroxisomal
  ENST ID: ENST00000416006
  CDS Start-End: 35-1852
tttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaaattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggagatagcatcttagaatggaagatgtggtgtgtcacatgcgtgcgtgcggagagaccaccaaacaggctttgtgtgagcaacaaggctgttatttcacctgggtacaggtatctcagcgtttgagtcagccaggagtagcaataggtttggcttggactcccttaggtggagaaatcatgttcgtggaggcgagtcgaatggatggcgagggccagtt

SEQ ID NO: 149596 - DNA, 2580 bp, Homo sapiens
  Payload ID: 9544
  Gene Symbol: LONP2
  Gene Name: lon peptidase 2, peroxisomal
  Uniprot ID: Q86WA8
  ENST ID: ENST00000535754
  CDS Start-End: 57-2483
ggggcagctgtctgtctggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaaattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtc

SEQ ID NO: 149597 - DNA, 1969 bp, Homo sapiens
  Payload ID: 9544
  Gene Symbol: LONP2
  Gene Name: lon peptidase 2, peroxisomal
  ENST ID: ENST00000565867
  CDS Start-End: 1-710
tccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacatcgaggagtcgcttcccaagtcaatcgtcgcctatgaccatttagctcaagtcggtaagcaaaattttcagcttgcttgcgtgttcctatcagctgtacgattgcgaagaactgctggtgaccatcgtatttttcctgtttctctaagactaacatgaagtgaaagccaaaacaggactgcatcatcacccagtcaacagcaccaggaagattaatgtctgtagcaagaaaaactatatcctctccctgtagggttgtaatggacttatgctgatgcatcagatggggcattacagcatccagagagccttgccatttacaggaagcaccagggcacggacaggaataaggcctaaactcacagagctcttcatggtctgctttttctgtgtgtggcagagttatttcacatccagaagacgcatatttacaggggaaaagtactgaattagccactttctccatagccaagttgcgaatggatcccaaagggccccggcaagttggacaacatgtgagctttgggcgacagttgctacaaacaagatggccactctgacattgaagaatgggcggtaacacatagtcaaagcagactggacactcaaaaagactcgccaagtcattgttggatgcagttgtgccagtcagggcaggcaccctctgggatggtggacacttcgaggtaccggtaggtaatgctgtagcagtctgacggctcatttctgaaataaatacataaggaggcaggagaaaaataattataaccatgacttactttataaataatgtttacatgccataagtccttttaaagtttcatacaaaatttactgagcaaaagaggaagaaaaataggattaaaaaagatattaaaaaaataaaattacactgaatgtgcactttattaggatctgtacactggataagctctcttttcaaaatgttccggaaaacatgtggaactcccttaatcgtctttggatagactacatagaataataaatgctaaaatagaaaatggaccataaacaactaaagaaactatacaaggaactgaagtttaatcgaatccgttttgctaggactctccctgaggctcccttactctatttctttctaatttggagtcagctgttgataggtacagggagttacaggtgaactcctgtataaaatcggcactctgtatccacacggtctgcatccgaggacttcaccagccatggattgaaaatattcagaaaaatttataaagaatacaaaatttttaaaatacagtctataacaactatttacatattgtttacattgtattaagtaatccagagatcacttaaattatacaagagaatatgcacatacaaatatgacaccattttctatcagggacttgagcatcctcaggttttggtat

SEQ ID NO: 149598 - DNA, 818 bp, Homo sapiens
  Payload ID: 9544
  Gene Symbol: LONP2
  Gene Name: lon peptidase 2, peroxisomal
  ENST ID: ENST00000570174
  CDS Start-End: 1-510
agactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgt

SEQ ID NO: 149599 - DNA, 2514 bp, Homo sapiens
  Payload ID: 9544
  Gene Symbol: LONP2
  Gene Name: lon peptidase 2, peroxisomal
  ENST ID: ENST00000566755
  CDS Start-End: 2-904
catgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagagaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggt

SEQ ID NO: 149600 - DNA, 3594 bp, Homo sapiens
  Payload ID: 9545
  Gene Symbol: LONRF1
  Gene Name: LON peptidase N-terminal domain and ring finger 1
  Uniprot ID: Q17RB8
  ENST ID: ENST00000398246
  CDS Start-End: 71-2392
gcggagccgcgcgcccgggaggctccgggaccgtggcggcgggcggcggcggcgcagccctccgcgggccatgtcctctccggcggtggcgaggacctccccaggagggagtcgggagatggccccagcgccgcagggccgaggccggttctgggaagtgggcggcggcagcggccatcggctggagcgcgcggccgcggagtcggagcgctgggagctgctgctccgccgcggggagctgctggcgctgggcggccacctgaagggcgcgctggaggcgttcgcggcggcgctgcgccgcggggccccggccaggcccgagtgcctgggcgccctggtggactgcctggtgttcaactaccggctccgccacgggctgggctggagcgcggccccggttgcaggcgctgacggcggcgccggcgggctcctcagatgcctgggctgccggggcttcctgagcgagccggtgaccgtgccctgtggccacagctactgccgccgctgcctgcggagggaactccgcgcccgctgccgcctctgccgggaccggctgccgcccgccaccgccagtgccactgatgctgaagggaccgccccgcggccgccgcctctggccgccgccatcgccgcttcagacttcagaaccagcgtcgtcctcaaccacctggccgagaagtggtttccgggccagcgcgagcgggcccgggcggccggcaggctcggggagctactgcaccaggggcgctaccgggaggccctggccgccgcctgcgaggcgctgcgagcagaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagaaactcccaatgaagtctgtatgttttccttagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaacactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaatactttttcttaaa

SEQ ID NO: 149601 - DNA, 3043 bp, Homo sapiens
  Payload ID: 9545
  Gene Symbol: LONRF1
  Gene Name: LON peptidase N-terminal domain and ring finger 1
  ENST ID: ENST00000533751
  CDS Start-End: 1668-2918
gcggccgctcgcttcctgccgcgcgctttccgggaattggctctcgggccgggcccgccgcggggaaacgactgccggggcggggagagaatcccccgcgagggcaactaggccgggcaggcggcgtctcccttcctcacccacaaaagtcaccgggacaattgggaaccgcgggagggcagaattgcataagctgggggcggggggcgttgtgtaacgggtgacgtccggtgggcgtggcgggagctccgcgcgggcgcccggccccgggaggccctgcaggccgccgggcttggggcttggggcggagctgcccagggtggtcccttgctacctggaaatgcctgaactggttcctcttgaaagtttcagctggcctgtttcagatcctgcttatttcctatgtactttgcagtgcacctagcttatggtaaagatgagaggggctgcctgatccatagttctctgccacgcttctcctggcctttccacttaggatcaggctgtggggaaaggccttataggtcttgagtgcatttcttagtctccaagaagcagcctcggcctcctaacctaggttagcactttcttcttaaggtggttttaggcgctgaaagggggcagtttcaagcttctcttacgtaaaaggaagagttgttctatataaatcagtagttctctaccagggggattttatctcccctctctcagggggcattatttagaacaatatctggagagatttttggttgccacctcttgtgggggtggtgctggtaccgacatctagtgggagaggctggggtgctgctcagacatcctactaggcacagcaggattcccacaacaaagaattatcaggccccaagtgccactgttgataaaccttgtgttacgcgtatttcaagatcttagtgtctatccattggcatgaaatgataggggaataatccccaagaaaacagacatctagaatagcaactgactttaggtattacaggtaaatttatagactgtgtaactgaaaggatcatctttcgggtcatcttttgtcccaagtgcttagtcatattgaactaatgtcaagatcttgtgttgtttagtatctttagagttcgaagcacaaaccccggagatttttgtattctttcagtgccttcgtgaggagtaggcaggtataaaatagaaaggtaggctcagaacaaaaaaaaagtatttggaatacagaattctgatacacatgactctgcttctctgggtgaataaagagaagagaaactggactcagttgtacagaccacctagtaactgaccatgaacccagtgacttgattgtaaaaatttacagagcggaatcatatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagaaactcccaatgaagtctgtatgttttccttagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcga

SEQ ID NO: 149602 - DNA, 1246 bp, Homo sapiens
  Payload ID: 9545
  Gene Symbol: LONRF1
  Gene Name: LON peptidase N-terminal domain and ring finger 1
  ENST ID: ENST00000524526
  CDS Start-End: 1-1131
ttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctt

SEQ ID NO: 149603 - DNA, 2841 bp, Homo sapiens
  Payload ID: 9545
  Gene Symbol: LONRF1
  Gene Name: LON peptidase N-terminal domain and ring finger 1
  ENST ID: ENST00000526680
  CDS Start-End: 312-491
catatgctggtctccaagagtttaaagcagccatagaagatttaaatgcagttctttttcaacttccagattggcctgaggtctacttcaggaaaggaaaagtactctgcgatgctggttttttaggtgatgccttacaactctttcttcagtgcttagcccttgatgaagattttgcacctgcaaagctgcaagtacaaaagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagttggatgaacccacggatgcagagcctgtggatacggagggccaactgtgctggcaaaaatcatttacttgtcacagtgttggaatcaaagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagaaactcccaatgaagtctgtatgttttccttagcttatggtgatattccagaagaattaatcgatgtctcagatttcgagtgttctctctgcatgaggttgttttttgagccagtaacaaccccttgcggacattcgttctgtaagaattgtcttgagcgttgtttagatcatgcaccatattgtcctctttgcaaagaaagcttaaaagagtatctagcagataggaggtactgtgtcacacagctgttggaagaattaatagtgaagtatctgcctgatgaactgtctgagagaaaaaaaatatatgatgaagaaactgctgaactctcacacttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaacactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaata

SEQ ID NO: 149604 - DNA, 841 bp, Homo sapiens
  Payload ID: 9545
  Gene Symbol: LONRF1
  Gene Name: LON peptidase N-terminal domain and ring finger 1
  ENST ID: ENST00000525024
  CDS Start-End: 90-689
gttcggtaatatttttcttgtatgaattctaataattaaactgtttttcccttagcttgaccaagaatgttccaatatttgtttgcactatggcctaccccactgtgccttgccctctccatgtatttgagccaagatacagattgatgattcgaagaagtatacagactggaaccaaacagtttggcatgtgtgtcagtgatacacaaaatagttttgcagattatggttgtatgttacaaattagaaacgtgcatttcttaccggacggaaggtctgtggttgatacagttggaggaaagcggtttagggttttaaaaagaggaatgaaagatggatattgcactgccgacattgaatatctggaagatgttaaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggcagcccctaatggacctgcatggtgttggtggcttcttgcagttctccctgtagacccacgataccagctgtcggttttgtcaatgaagtctttgaaagaacggttgaccaagatacagcatatactgacctatttttctagagaccaatctaagtaactaactctttggatctccctttaaagtgaccctaatctggctgcattgatggccagattgtctgctgcctttgcacatctagtgctggtttcagaaatttaatgaaacttttctttttccttcgacctcctgaatcatgtggttctgcaaat

SEQ ID NO: 149605 - DNA, 679 bp, Homo sapiens
  Payload ID: 9545
  Gene Symbol: LONRF1
  Gene Name: LON peptidase N-terminal domain and ring finger 1
  ENST ID: ENST00000534446
  CDS Start-End: 242-421
aggcatattcctgaggtaagcacccagaaatttgattctccagctgtctcccagcttatttcctcgctattatagggaagctgccatggggtgcttctaaccaagtattgggcagcagtaactgcccacacagattttatgtgatttattattacctgaaaacttaaaagaaggcctgaaggaatcttcctggagttcattaccatgtactaaaaacagaccttttgattttcattcagtgatggaagagtctcagtctctcaatgaacctagcccaaagcagttggatgaacccacggatgcagagcctgtggatacggagggccaactgtgctggcaaaaatcatttacttgtcacagtgttggaatcaaagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggagcttatggtgatattccagaagaattaatcgatgtctcagatttcgagtgttctctctgcatgaggt

SEQ ID NO: 149606 - DNA, 13912 bp, Homo sapiens
  Payload ID: 9546
  Gene Symbol: LONRF2
  Gene Name: LON peptidase N-terminal domain and ring finger 2
  Uniprot ID: Q1L5Z9
  ENST ID: ENST00000393437
  CDS Start-End: 641-2905
cctccccagtcatttaggacaatttcctaagtcgaagctagagatgcgtgatgcgtttggtgacttttcctgggttcttgcttaagcggagccacaggttgtgggggcggccaggcctctggggaagagcaggtgccgcggtgccggcgcgccagcagcccgcggccaaggccacctgctcccagggccccggcacctctgcggggaggcggcaggcagaggacgcgcgcgcagtcgcgcaggagccctcaggcgagtgggggaagcatcgcaagagacgcggacctggagcgcggtcactgcgttaccgcagcgacctgggttacctaagccggcgggactgagaggccgctgcgcgtgggcaggggctcagattgcgcccgcggtgcctgtcccggcccccaccccggaacgattgcagccctgcggggctcgccgcccacaccgcgctgaggacgctgcccaagccaggcgcccgcccccgcccgcggtctcagccgctcgcagcgcgccgcccccagacgcgcgtggctgctggcgagggctgagaccgcgctcccgccggccagttcccagcagcagcgcatcctccctgctccgcgccttcgctccggacccgcgtcgtcgcagccccgcggtgatgagccccgagccggtcccgccgccgccgccgccccagtgtcctggctgcgaccgcgcggagccgatcgcccagcgcttagaggagggcgacgaggccttccgcgcgggcgactacgagatggcagccgagctctttcgctccatgctagccgggctggcgcagccggaccgcggcctgtgcctgaggctgggggacgcgctggcccgcgccggccgcctccccgaagccctgggcgcgttccgcggcgccgcgcggctcggggcgctgcggccggaggagctggaagagctggcgggcggcctggtgcgcgccgtgggcctgcgcgaccggccgctgtccgcggagaacccgggcggcgagcccgaggcgcccggcgagggagggccggccccggagccccgcgcgccccgcgacctgctcggctgcccgcgctgccggcggctgctgcataagccggtgacgctgccctgcgggctcacagtctgcaagcgctgcgtggagccagggcccgcgcggccgcaggtgcggcgcgtgaacgtggtgctgagcggcctgctggagaagtgcttcccggccgagtgccggctgcgcaggctggcaggccaggcgcggagcctgcagcgccagcagcagccggaggccgcgctgctcaggtgcgaccaggccctggagctggctcctgatgataattcattattgctgctgcgggcggagttatatttgaccatgaagaactatgagcaagctctccaagatgccagtgcagcttgtcagaatgaacctctcttgattaagggacatcaagtaaaagctcaggctctttctggattgggaagaagtaaggaagtgttaaaggaatttctctactgccttgctctgaatcctgaatgtaactctgtgaagaaagaagcacagaaggtaatgtgtgaagtgctgttttcagctacagcaaatgtgcatgaaaatttaacatcttccatccaaagcagattaaaggctcagggtcacagccacatgaatgcccaggctctgctggaagaaggtgatgcagggagctcggagaattcatctgagaaatctgatatgcttggaaataccaattcttcagttttgtattttatactgggtctacactttgaagaggataaaaaggcgttagaaagcatccttccaacagcacccagcgctggcttaaagagacagtttccggatgacgtggaggatgcacctgacctgaacgcccctggaaaaattcccaagaaagatctctcacttcaaaggagcccaaactctgagacagaagaaagtcaggggctctcgcttgatgtaactgactttgagtgtgccctctgcatgagattgctctttgaacctgtcactacgccctgtggacacacattttgcctaaaatgccttgagcgctgccttgaccacgccccacactgtcctttgtgcaaagacaaactttcggaattattggcaagcagaaactttaacataactgttctggccgaagaattaatatttcgatatttgccggatgaattgtctgataggaagagaatttatgatgaagaaatgtcagaactgtcaaatctgaccagagacgtccccatctttgtgtgtgccatggccttccccacggtcccatgtccactccacgtttttgagccccgctatcggcttatgataagaagatgcatggaaactggcaccaagcggtttggcatgtgtttatctgctgagcacgcggggctttcagagtatggatgcatgctggagattaaggacgtgagaacgtttcctgatggaagttctgttgtagacgcgattggcatcagtcggttccgagtgctaagccaccgccacagagatggctataacacagcggacattgaatatcttgaagatgaaaaggtggagggtccagagtatgaagaacttgccgctctccacgattctgtgcatcaacagtctgtttcctggttcgcgtctctccaggatcgcatgaaagaacaaattttaagtcattttggggtaatgccagacagagaacctgagcctcagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgcattgggatgtcaaacataaaaccaccaagtgcaaagaatgctttgaaagtagaaccttgtctcattgatcagtggttactaagcatttaggaaacagtcatctttttctattgggatttgcattagaaattagccccatcagtaaatttcagtttactatccatttattaatatacaaaaacattaaaaaatctgccatgccatggtaatctatctattccaggaaaatagatcagaatatatgaagggaggatggccggtatgggatgtaaatattcagtaagtttttctccaacaccaacctaaaattatctttatttttttgaaagaaagttttacggtgatcagaccaggtgttatctgttaaaggacagtagtatgacttccatcctgtaatgcacgttggtgatattgattggaataactgaatctgagatactcatatgttctctctggcccaaccagctggtgcatttggttggcttcctcgtctgtaaggtggacattcttaaccagagggtcacgaccacatcacagctgcaagttttgctttgttcattgaaggtgattttttagttttaaaatatatatatctcataatatacaatgttgatggtatatcaatccatcaagcattttattagaaagactttataatattattaatttttctttagttttcagtagataaagtagtttcagtagataaagactttataatattattaatttttcttttagttttcagtctcatcatgggagttagaaaataccagcatcacttaattgtaaagagaaaatgtgaaagtattttccaatccaatgtttcaagtgcctcacttattgtgaatctcaaatatcatcttgagatggtttaatggcagtttggccaagtgatttctaagagattttattaatttatgcattaacaatagtattcaactttcttaggcattataacctaacccgatcatttgattggaataactgaatcattcattgattggaataaaataaagaaaacaaaatgcatctcacatgccagaagacctttaccagaagtggttcatgaaaatcagtatgcattgaccattctctgcctttcccttttggaaaatttttttgtaccttcatatcacagctgaatagttatcaatgccatttccatttggaagtatctaaataaccacaatgtgatcacagcttctccacgagccttcctgaagtaaagctggtatgcttgctataatacttggaacctgttgctttctcttcctcactctttaaatgtcataaggtcacacagttcttggaatcagaactattcagttatttcttcatgattctgcctggctttctgagtcttctccttcggcatgttatgtaaaagtctgaacaacaatgatgacgcagacgagagcaacatacgtttttattttttgataggtttttatttttttgataccagagggaattaactatgatcacatcgtgctctctctgttcagcatcacacgcccacatactgcagtgtgggagtagattggtacttactgagcacttagaaacatcacgcatcaggaaccgggtcagggtgacagcatcctacggtcatatcatgaaggaagcctcccttacaaacctaaaaaaaaaaaaccccagcttcagtttgctaccaattaagctaaagcagaacggtctgcttcctcctccgcctgcccccttctgcctcttttctgttggggagatgccaattctaaggatttctcagaaaataatgtaatctctcattcaatgtcaggacattccagcttaattgtactgaaagtgctccaataggcatgctctcgttacattggaatcaaagcagaaaagagtaatagcagcgtgggggagtcatttttcttcttgaggaacaatacatgctgttctgtatttttccattcatcgcccaaacctgcctgtgtctttgaaatgcaagtaagatcccaaaggcagctttctgaaagcccgtggcatttttagcttatcccatcccccgtgtgtgtcctcatcttcagaattgaaagttaggatactttttaaagtttcaaaagaaaataatttaaaatgttaaggtttatccatagaaacacaataattcttaaccaattcatgtaccaaattcaacagtattatctcatttttagggtcacaaatgtgtcctttttgcacttaaacctcctccctctctcaaaaacaaaaacaaacaaacaaacaaaaaacacaccaagactgtttaacaaattgtatctcaactcttaatatatgttaagtcttaccacaggacatttgaatcatcaaggaacagttgaagtttatggatggtagaataacaatgaactatgatattatcactttattataaactttttggaaaattggcagttgctaccatcgaaatactccattgcctgtgttacatagaatttgttataatttttaagggctttaaaaaaatacccatctgtttcttctccttcttgttttcttttgtgccccaccacttaaattacttgggtaaataccactcttcaaaatttgaatactgtctatcaaataagaagaagtgtgaaagatatgaagaagaaaggtgatagcaaattagaagaaaataaatgtgggtgatttcttttagttgaaagcacagagttttatttttccccagtataactattgagtagggtagggaggtccctgtatccccatttttattttttttgagatggggtctcactctgtcacccaggctggagtgcaatggcgcaatctcgtctcaccacaacctccgcctcctgggttcaagtgattctcttgccttggccccctgagtagctgggattacaggcacgcgccaccacacccagctaatttttgtattttttttttttagtagagatggggtttcaccatgttggtcaggctggtctcgaactcctgaccccatgatctgcccgcctcggcctcccacagtgctgggattacaggcgtgagccaccgtgcccggcccatctccccatgttttagcatagacagcagcggcattcagtggaaggagttcttccccttcaacatcgtccttcccaaaggccacattctgattctattgttcaccaaaaactaattcccagggaagcccgctctggatgggaaggatgagctgcgtgagccatcgcccacacagggagataaccgaacccctttgccagcatcaccccctctctactggggtgagacacttcattcagagcactggctctgactcccaggggaaagtctttttccctttacaactcctcacctcagcctcaccttgactttcacttctcaactgctgaattctataaaatagccttttagcagtgactcagcttttaggtgagcacagataatgaagaaattgaagtgccaccattgcactcccccaagttggggacataaactcgaatttgcacccaggtctgataaaagtaactgattgaggacgcagaaaggtggatgccattgacagcgttgactgttctcacaattcctacagaaatgaaagaaggagaggcccagcagaccacaccgggccatgaggggaagcatgggagacaggcagaagcaggagtgaggaggaacgtggctcagaccctctactgtatgttctgcaggaaagggcagggaaatagctaagactggctggtctgaataacagctcagactctaggctatacaggtggtctctagccatctggcacctagccccgggtcgttagggtgggggatattgcttcctaggttgtaagagccagatagaggaggatgggctctggattggtcactttgctcccagggtagccctttgctgtatctaagaattggctcaccctgggatgggcagtttctcctgggtcagcgaggcccctgagatgtcaaaatatcataaaatatagaaatcatgattaatacaattggtcctctgctgttttgacatactaaggtcacttttgatagcagaaacttttaaagagtagggcatacgttgccctgaagagcatagaaaacattttattctgagagtagaaaggaggaagacacgtggagatacaggagtcccttaggctggcccatagctgagtctctcatgtgtgtggcattagtcaagaatgtagttctgcagtttgcggggggggggtctctaacatttcttggtgcagttgttaacatgtgttaaacatatgagtctgatgatgatatcgcggtgtttctcggctcggggtggcaggtctggcggttgtgtggctgggggtgtgcactgatagttcagtaaaggataagtagagactcgtggtgttcatgtgtcaccacagggagggagtggctgtggagacccaggacaggaagtcgcggtggaaagcaggctggggtggtaggagaaggcaccgggggtgggtgctcctcccccaggggttgaggagttgactgatagggggcagttacctcctgggaaagcaagacgctcccttaagttttagaatggtacagagagtagtcccttctaccagagtttccatttagacatgggagtgtagggggccatgtttcggcagaagcagggcatgtatcagcattagtggactcctcagtattaaaaggaagaacagcaaacatgtcatgtgcccactttgtgcctcaggagaggtagcccgtggacatcgctagggcagaggttttaatatctgggacaaagttatctcccacggcgaggtcgtggctgggaccatgtcatcttcagccgtgagctgctgggctgggcaatgtcttctgggatgtgagacgtggggtctcctttctaagcggacccccactcgtgctgatgtgggtcccagcatttgccgcgtttggttgaaacagtggcttacctggagggtctgggtctctggatcataaaccagcgaaagcccccacatcagtggtgacaagatcaatagaccccagaatgtgtgcagctgtgcttgatagggttttggttcttgctttttggtggaagtttaggctcaagtgggtcccgtatcggatgagcagctgcacggcctgtgggagccctggggttagtgggtccaggagagaatgtgttctctctctgggctccagccctgatggggtggggataagatgcaagatttataggaatagggggaaacattatggaaggccccaatatgtaatgagcttttatatacaagaatgcaagacatagccctctttttatgtttaaaggggactatggtaatgttttttaaagtttgtgtgaggtgtgagtcaaccgaaaggccctaaattaagagagattcaggtttgtggtgcaagatagaggcccatttcggggtctgtttgcagaccagaatttgaaatggagttgtttgaggagaccattgtgtgtcttcgtgaaaccgattgtgtggaacctatcagggctgtggaagttgtagcgaatgccttttcccagagcccagcattgtggattccgagaagtggcatgtgtgtctcagtgacttccagtgatgcctgccactctgaagagatgaaggagtgtcctggcaagacctggaatcccagctgtagcacctgtggagagatgtgatttagatttggatttggggtatctgtgaggaagagtcccagagtttttcatcctgaagggggcaactcttgggcagtggtccaacagttggccataaatgtgaagctggggcgctgtgctgaccagggcatccagcgttaagacgactgcctaactttggccacatgcgttgttttttgggttccgtttcgtatcagggcatgctggctaaaagatgggaagcagcaacattctcttgggctccatcatttatatgagggttggcaatgccatctgtaccctctgtgaactcccactgctgttcactcagttaatctaagggacaccaaggggtctgcgggaggatgacctcacaagggactgaggacatgggagaccaccctcctgtgggtagaatacaccagagggcccaggcttgactctgtcctgtgttaaggaggcatcggtagttttgctgagcttgtcaggtgtttataatggacagttggagattggggtcctaggcttaggtctttgagagcctctgtgtccaggagagcccagtaggcatccagccatttactgctttaatagggtagcatgaggctgagagggatagtttcttgcatccaaagcccttaggcaccttatgtccatcctaagtgggccagagactccagggctgcatagagcttgccagagcttctataatgaaggggtctctgagggcaccaacaggagtgcccatggattttaaggtttgattatagaggttgtttatggagggtgccccatttaaagcaagctgatttgtaagcagcagcaagaagattaagtaaaatttgtaaatgaggactacattgccatcagaacctcgaaagtatctaaagatgttggacttgtatgtccttaatgagtgtgacaatgagtttcctcatttgtgctcctggagaaggcggatgtggtgaagaccctgtctgcagacattgtgtgccatggcaaagccgtggagctccctgtgggtggcctgcaaaggtgtatgtgcccctcagggcagaaggcaaacggcagccaagaagctgtgcaagtagacacttaatgggacatgttagccaaatctgtaagagcaaaatattggccagttatttattgtgtagaattaataattttaataataatggaaattgggtaatggatgggactgcagcaataaggttgtagtaatccaccatgaggcacacttgtttttttccaggtttaaggataggaaagattgggctgttcaatggagaaacaagggtataatcacccctttattaattagtaagttttaatccttgaatacctcatattaactgttttaactggaggtccatggggcatcattttatcaagctagtttataactgccaaagactgactttaattttaatttattatttgttttattagagtgtctgtgttcaatatgggatattagggcgttgggtactatgaccacaggaaatttagacaggctacagttaaagtgaagcataccttacccatccaccccccattttatatttagttgcctttttaaaaagattataggggtacaatgtttagatttagtgggatctccaggtataactgtaatttgagccccagtgttaagactatgaagctttgtcaatgggtacattttagcaaatgttacaattaatttagaacctaagttatggagacacaaaagccaataggcacccttttatgttttggttaaatgtttcagtatatacatcttatttatttgtaatattagtatataatttgttgtatacatttttagtgtataagcgttggatttctaattggatcagattagggaccttccgtttagctgcatatgtacatatacatgtacaatttattatatatttgcgttaaaatagcctatctgcatgtgtatatatgtgtgtatgtgtatgtatatgcactcacacgcataaatacacagtctatttagttacctttaatgttttttcccttgtacctaggctttttctcgctttttcctttttttctgattttgtggcaatttagttggaaggaggcggtcccagcatgttgacaggcagggtgttcagagtgcccaggcacactggtggggggtggttacaggctcacgtagctcaggggcttctgcaggtctcaggggagtgggaacaaagtgtcccaccccttccccttttcctcaaacctcaagccactggtctctatggatagatcctttgcatcccaccggattgaggaatgagtcacaacagctgcaaggctcttaaagcaacatttaaaccttttggcggctgtcatttctgtgaggagggtgcctctcaccggccgcatggccggaggatccctgcagcgctttggagaccaacacccagatcctttgcccaggagtgcgattaattcctcactggatgctgggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaataggctagactgatgagaaattagatcaaatcagtgcctaggcctttgtgtttgtgtcgtagggatgtactaacacatcaccacagactgacggcttttcacaataaatcagttttcttcgctca

SEQ ID NO: 149607 - DNA, 2363 bp, Homo sapiens
  Payload ID: 9546
  Gene Symbol: LONRF2
  Gene Name: LON peptidase N-terminal domain and ring finger 2
  Uniprot ID: Q1L5Z9
  ENST ID: ENST00000409647
  CDS Start-End: 72-1607
agtggcagtctgtttttcttgctcctgatgataattcattattgctgctgcgggcggagttatatttgaccatgaagaactatgagcaagctctccaagatgccagtgcagcttgtcagaatgaacctctcttgattaagggacatcaagtaaaagctcaggctctttctggattgggaagaagtaaggaagtgttaaaggaatttctctactgccttgctctgaatcctgaatgtaactctgtgaagaaagaagcacagaaggtaatgtgtgaagtgctgttttcagctacagcaaatgtgcatgaaaatttaacatcttccatccaaagcagattaaaggctcagggtcacagccacatgaatgcccaggctctgctggaagaaggtgatgcagggagctcggagaattcatctgagaaatctgatatgcttggaaataccaattcttcagttttgtattttatactgggtctacactttgaagaggataaaaaggcgttagaaagcatccttccaacagcacccagcgctggcttaaagagacagtttccggatgacgtggaggatgcacctgacctgaacgcccctggaaaaattcccaagaaagatctctcacttcaaaggagcccaaactctgagacagaagaaagtcaggggctctcgcttgatgtaactgactttgagtgtgccctctgcatgagattgctctttgaacctgtcactacgccctgtggacacacattttgcctaaaatgccttgagcgctgccttgaccacgccccacactgtcctttgtgcaaagacaaactttcggaattattggcaagcagaaactttaacataactgttctggccgaagaattaatatttcgatatttgccggatgaattgtctgataggaagagaatttatgatgaagaaatgtcagaactgtcaaatctgaccagagacgtccccatctttgtgtgtgccatggccttccccacggtcccatgtccactccacgtttttgagccccgctatcggcttatgataagaagatgcatggaaactggcaccaagcggtttggcatgtgtttatctgctgagcacgcggggctttcagagtatggatgcatgctggagattaaggacgtgagaacgtttcctgatggaagttctgttgtagacgcgattggcatcagtcggttccgagtgctaagccaccgccacagagatggctataacacagcggacattgaatatcttgaagatgaaaaggtggagggtccagagtatgaagaacttgccgctctccacgattctgtgcatcaacagtctgtttcctggttcgcgtctctccaggatcgcatgaaagaacaaattttaagtcattttggggtaatgccagacagagaacctgagcctcagagtaatcccagcggccctgcctggtcctggtggatcctggccgtgctgcccctggagcgcaaggctcagctggccatcctcggcatgacctcgctcaaagagcggctccttgccatccgacggatattagtcatcatcacgcgtaagatgaatagtcggcaagagctggctaatgccagggagagaaataattgatttttctctctgtcaaggtttctggcagcccttgtgcttttataaatgtcaggcatggacgaatagccgtccattcattgtgcttcatcaagtgcttgtggatgaggttccaaaatgggacgcttgccaaacattgagtcctcctcaaaaatgacaattctgtgtctggtgggatctgaccttgtgtgaggttagcctgaagtctgaatggagcccatagttggaaaacaacctaagaaaatctcttagaagcaggtgcttggggaatgcagttcactgacagcacaggaccctgcagatggtttacatgtggtttgggtttcacgagaaagaaggattcacttcccagtcagcatctggctctgccagatggtaaaggcgtgctttagtgtgtagacaatatgggggaaccacgtttttatctggaagtggatttcttagaacacaggctaaccaaaactacgcttaggctttgcgtgttgctgtgaagttgtctgtgaaatcgaataatcacaccattgttcagtgcaggagcccaaactagtccttacccaagaagtagtagcctctggatagaactgtgtttaatgtcctgttgtagtcccaggtgttgtaaattgcatgttgtaatcaaacgaatgtcaaaacataagaaagtataccttggatatagaaaaacctgagaacagtatcattcacttgaggatatatatatatatatttacacacaataaagtgagttaaaattgtatatgc

SEQ ID NO: 149608 - DNA, 2989 bp, Homo sapiens
  Payload ID: 9547
  Gene Symbol: LONRF3
  Gene Name: LON peptidase N-terminal domain and ring finger 3
  Uniprot ID: Q496Y0
  ENST ID: ENST00000304778
  CDS Start-End: 168-2324
agttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaataatgttcatacttctttctgttttaataatttattttttgcactactgtatccttttttctacatgtatgtttgtaactatttaagcgtacattgctgaaaagtccattgctttatttattgatgtggtttaccatgtacctagggggaaataacaatactagaagtgtgcagtttttgcttttatcttttttttactacaatgacactagttcttag

SEQ ID NO: 149609 - DNA, 2550 bp, Homo sapiens
  Payload ID: 9547
  Gene Symbol: LONRF3
  Gene Name: LON peptidase N-terminal domain and ring finger 3
  Uniprot ID: Q496Y0
  ENST ID: ENST00000371628
  CDS Start-End: 32-2311
acgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggcacatttcagaaaagcccaagccttagccaccctaggcaaggtggaggaggcactaagggagtttctctactgtgtatcccttgatggaaagaacaagagagcaagatgtgaagcccaaagagacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtg

SEQ ID NO: 149610 - DNA, 2898 bp, Homo sapiens
  Payload ID: 9547
  Gene Symbol: LONRF3
  Gene Name: LON peptidase N-terminal domain and ring finger 3
  ENST ID: ENST00000422289
  CDS Start-End: 722-2233
atcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacagctccaaatgaccacttgctttatagcaatcggtctcagatttatttcaccttggagtctcatgagaatgcactgcatgatgcagaaatagcatgtaagctccgcccgatgggttttaaggcacatttcagaaaagcccaagccttagccaccctaggcaaggtggaggaggcactaagggagtttctctactgtgtatcccttgatggaaagaacaagagagcaagatgtgaagcccaaagacttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaataatgttcatacttctttctgttttaataatttattttttgcactactgtatccttttttctacatgtatgtttgtaactatttaagcgtacattgctgaaaagtccattgctttatttattgatgtggtttaccatgtacctagggggaaataacaatactagaagtgtgcagtttttgcttttatcttttttttactacaatgacactagttcttag

SEQ ID NO: 149611 - DNA, 1873 bp, Homo sapiens
  Payload ID: 9547
  Gene Symbol: LONRF3
  Gene Name: LON peptidase N-terminal domain and ring finger 3
  ENST ID: ENST00000439603
  CDS Start-End: 1-1576
gtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaa

SEQ ID NO: 149612 - DNA, 2895 bp, Homo sapiens
  Payload ID: 9547
  Gene Symbol: LONRF3
  Gene Name: LON peptidase N-terminal domain and ring finger 3
  Uniprot ID: Q496Y0
  ENST ID: ENST00000481285
  CDS Start-End: 164-1996
attaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggcacatttcagaaaagcccaagccttagccaccctaggcaaggtggaggaggcactaagggagtttctctactgtgtatcccttgatggaaagaacaagagagcaagatgtgaagcccaaagagacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtt

SEQ ID NO: 149613 - DNA, 441 bp, Homo sapiens
  Payload ID: 9548
  Gene Symbol: LINC00116
  Gene Name: long intergenic non-protein coding RNA 116
  Uniprot ID: Q8NCU8
  ENST ID: ENST00000611969
  CDS Start-End: 38-208
gccgcgccgtagaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacat

SEQ ID NO: 149614 - DNA, 2051 bp, Homo sapiens
  Payload ID: 9548
  Gene Symbol: LINC00116
  Gene Name: long intergenic non-protein coding RNA 116
  Uniprot ID: Q8NCU8
  ENST ID: ENST00000414416
  CDS Start-End: 1401-1817
gttaaaggtcaaaggtcacctccgcaaatggcaccaactgtgtagcctggcagtgggactttgtccagctttctgatcagtagaatagaaggatgccttcctccaagacctgtttggagaattaaaccagctaatgtaggagccacggctgccgctggggagggcccagtaattattagttccctccccgtcctaggggaccccccaggagagcgtagtgtgggctcctagtggggcctctcgaggcaaatacctcccgagagggggcgcgcgccctcccctcttcccatggggcgcccccagttccagcctgacctggaactcagggttgccagagctgctgaattttcaagagaaagcggaaatctgagttttaatgagaccgctcctgattttttaaaacgttgatcatgaagttaaaacaataataatgggacagggtttcaccatgttaaccagtctggtcttgaattcctgacctcaagtgatctgcctaccttggcctcccaaagtgctgggattacaggcatgagctgtcgcactcagccaacattcctgtttttgaaaatcctccaatccctgaagtctgtattacaagaccaattctgcattgctgagagagactgtgctttacagagagtaagatccttgatactggctcagcatggaacatctggcacacagtatgcactgaggaaatacttgttggaataatcagtgaatcatagatgaaaacttaaccttggaattaattatgagactgctcagaggaagagaatgggagacaaaggacctggtgattagacccccaagacactgggctgtctgcttgtgtctcgggtggaacaggcccagcgagagtctttagggccagaactcaagaatttattgagcccttgttctaggcacttgggattcaccagtatacaatggagacaaaaatccctgccctggagcagcttacattctagcatggcaaacaggcagtaaacagcccattctggctgctgtattgagaagagaatgtggtggacagatatagaagcatggaaacctgatagggctattgcaatcactcagaaaagaggcgatggcagcttggacctgttggaagcagtagagtgcttccagggaggagaaaggacctgaaggttaatttgatcaccaatggccaatgatgtaatcagttatgcctatgtaatgaagcttccgtaaaaaccaaaaggattgggtttgattgagcttctggatagctaaacatgtggaagttcctggaggatggtggtcctaaacagggttaccagaaaatttaaagttacgccagtcactcccattctattgctgagagaaaatacagagcggtgaagagcttacagtcgggtgagcaagatacgcccccaatgttagctaatgatgtaaggcatcaacaagaaatgtgggggttcaggaaagtggaaggtggggtcgtccaaagcctgggaaagtcttcagttgaaggcgagacagatgggactattagtgagtttcgagagatccaacgcctcgccgccttcgcttcatttttgtctcacgccccacccttgaacgcgcggcgccttttgaccccgccgccgcgccgtagaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacatc

SEQ ID NO: 149615 - DNA, 461 bp, Homo sapiens
  Payload ID: 9548
  Gene Symbol: LINC00116
  Gene Name: long intergenic non-protein coding RNA 116
  Uniprot ID: Q8NCU8
  ENST ID: ENST00000426713
  CDS Start-End: 58-228
aaaatacagagcggtgaagagcttacagtcggaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacat

SEQ ID NO: 149616 - DNA, 305 bp, Homo sapiens
  Payload ID: 9549
  Gene Symbol: LINC01420
  Gene Name: long intergenic non-protein coding RNA 1420
  ENST ID: ENST00000451583
  CDS Start-End: 1-122
cctccgggagatccactctcccacctggaaacgcacgggaagccaagcctccaaaaaagcgctgcctcctcgctccgcgttgggattatccggaaggaactcccaacggagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcgcgatttcacttcctgaatttcgatgaattctaagacat

SEQ ID NO: 149617 - DNA, 543 bp, Homo sapiens
  Payload ID: 9549
  Gene Symbol: LINC01420
  Gene Name: long intergenic non-protein coding RNA 1420
  ENST ID: ENST00000423617
  CDS Start-End: 1-207
atgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtcttatgatgtaatcagcgcgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaat

SEQ ID NO: 149618 - DNA, 1529 bp, Homo sapiens
  Payload ID: 9549
  Gene Symbol: LINC01420
  Gene Name: long intergenic non-protein coding RNA 1420
  ENST ID: ENST00000374922
  CDS Start-End: 96-302
agctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcgcgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcagataaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaaatcacaaa

SEQ ID NO: 149619 - DNA, 466 bp, Homo sapiens
  Payload ID: 9550
  Gene Symbol: LINC01556
  Gene Name: long intergenic non-protein coding RNA 1556
  Uniprot ID: Q5JQF7
  ENST ID: ENST00000383656
  CDS Start-End: 28-216
tcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccagggaaggcggtacatctacgaaagccctaatcatagagggaaagactcctcgttcctggcccagaaatgagatgagaaatccagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatca

SEQ ID NO: 149620 - DNA, 466 bp, Homo sapiens
  Payload ID: 9550
  Gene Symbol: LINC01556
  Gene Name: long intergenic non-protein coding RNA 1556
  Uniprot ID: Q5JQF7
  ENST ID: ENST00000434916
  CDS Start-End: 28-216
tcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccaggaaaggcggtacatctacgaaagccctaatcatagagggaaagactcctcgttcctggcccagaaatgagatgagaaatctagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatca

SEQ ID NO: 149621 - DNA, 466 bp, Homo sapiens
  Payload ID: 9550
  Gene Symbol: LINC01556
  Gene Name: long intergenic non-protein coding RNA 1556
  Uniprot ID: Q5JQF7
  ENST ID: ENST00000438996
  CDS Start-End: 28-216
tcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccaggaaaggcggtacatctacgaaagccctaatcatagagggaaagactcctcgttcctggcccagaaatgagatgagaaatccagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatca

SEQ ID NO: 149622 - DNA, 466 bp, Homo sapiens; identical to SEQ ID NO: 149620
  Payload ID: 9550
  Gene Symbol: LINC01556
  Gene Name: long intergenic non-protein coding RNA 1556
  Uniprot ID: Q5JQF7
  ENST ID: ENST00000438403
  CDS Start-End: 28-216

SEQ ID NO: 149623 - DNA, 466 bp, Homo sapiens; identical to SEQ ID NO: 149619
  Payload ID: 9550
  Gene Symbol: LINC01556
  Gene Name: long intergenic non-protein coding RNA 1556
  Uniprot ID: Q5JQF7
  ENST ID: ENST00000421470
  CDS Start-End: 28-216

SEQ ID NO: 149624 - DNA, 513 bp, Homo sapiens
  Payload ID: 9551
  Gene Symbol: LINC01620
  Gene Name: long intergenic non-protein coding RNA 1620
  Uniprot ID: Q4KN68
  ENST ID: ENST00000372910
  CDS Start-End: 1-513
atggcttactatttccatttctacggagaactgccatctcaggaatcacctcaccctggagtttattcccctcacccacagggtggctggcagccaacagctgactcgtacagagagtggcacaatgaagatttgaacccacgtatgtctcactggacgtatgcccaggaactggtaagctataaaaagacctcctttattgtctggagacatagaattagtccaaacggtgtcacctccaggaagccttactgtcacttccatggaggacagtggcctgggcccacaccaccctcctgcctgtcttcagcctttgctagtggatccttttcccacttcgaagactccccttacatcctcctccatgttgtcctccaaatgtgctggctgagagcccagcgcctgaatcagagggacctgggtttgaatcccacctctgccattgaacaccagctgtctgaccttgactgcgttcctttgcttctctgggcttcagattccccatctgaataa

SEQ ID NO: 149625 - DNA, 505 bp, Homo sapiens
  Payload ID: 9552
  Gene Symbol: LINC00493
  Gene Name: long intergenic non-protein coding RNA 493
  ENST ID: ENST00000411646
  CDS Start-End: 60-347
accggaagtcccgcctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagtagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaacta

SEQ ID NO: 149626 - DNA, 575 bp, Homo sapiens
  Payload ID: 9552
  Gene Symbol: LINC00493
  Gene Name: long intergenic non-protein coding RNA 493
  ENST ID: ENST00000435844
  CDS Start-End: 133-417
agagccggaagcggacgctgaaaactggcggctccttaatggttccggcggcagggaccgcagcgacgccctcaccggaagtcccgcctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaacta

SEQ ID NO: 149627 - DNA, 670 bp, Homo sapiens
  Payload ID: 9552
  Gene Symbol: LINC00493
  Gene Name: long intergenic non-protein coding RNA 493
  ENST ID: ENST00000608034
  CDS Start-End: 33-254
ctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcaggtctcaccctgtcgcccaggcttgagtgcagtggcatgatctcggctcaccacaacctgcgtctccgggctcaagtgattctcctgcctcagcctcccgagtagctgggattgcaggcgcaggccactgctgcccggcgaattgttttattttttttttgagacagagtctagctctgtcgcccaggctggagtgcactggcgctatcttggctcactgtaacctccatctcccaactcaagcagtcctcctgcctcatcctccccagtagctggggttataggcccatgccaccacgcccagctaatttttgtatttttagtagagatggggtttcactacgttggcgaggctggtctcaaacacctgacctcaggtggtccacctgcctcggcccccacaaagtgagattgggattacaggcgtgagccaccgcacccagcttttcttttcccttccttttcattccttccttcattattggggttggagagagtggatgtaattcttaccttagtta

SEQ ID NO: 149628 - DNA, 769 bp, Homo sapiens
  Payload ID: 9553
  Gene Symbol: LINC00694
  Gene Name: long intergenic non-protein coding RNA 694
  Uniprot ID: P0DN24
  ENST ID: ENST00000634610
  CDS Start-End: 88-393
agatgagttctccctgtgttgcccaagctggtctggaactcctgggctcaagcaatcctcccacctcccagtgttgagattataggtatgtctagaggtcagtttggacagggacaggaacctctagacatgtttttctgggtgaacgagataagcggagaaatcacctaccccccgcagaaggcagatgcacctgctgtttctcctgagagcccacaaaagaagcccccatttcagcccaggagtgtgcaggaggctccttgcagtccccagggcccgcctgcacagaggcctgcccttgcacctccatctaagccttctctgaaagactcaggctcaagaaacccctgcccatctgcacccacctgggccaggccaaagccggaggagtgaggagcccccaccgttctcagcaatccctgtcaccatctcatcaccaggagtgactctgcccatactcggacccctgggaccagcccttcagccaccggtctcgacctctcctctcagcccttctgcaccctgggccttcacctgcaagctgaacaatgtccttactgggaataactggttttccttttgaatcttaagaaaatttgtctggctacactctttaagcaccttcctgagccacccgtggccaggctctgctggccgcatctgcctggccccatctaccttccctggaagcacaggactcaccccaggggtctcacaggaacatgcccagtgctttcaaacccagtaaaattttacttagattttgaca

SEQ ID NO: 149629 - DNA, 729 bp, Homo sapiens
  Payload ID: 9553
  Gene Symbol: LINC00694
  Gene Name: long intergenic non-protein coding RNA 694
  Uniprot ID: P0DN24
  ENST ID: ENST00000416124
  CDS Start-End: 48-353
tgaagctccctccacagactcctccaccccagaaccttccgacaggtatgtctagaggtcagtttggacagggacaggaacctctagacatgtttttctgggtgaacgagataagcggagaaatcacctaccccccgcagaaggcagatgcacctgctgtttctcctgagagcccacaaaagaagcccccatttcagcccaggagtgtgcaggaggctccttgcagtccccagggcccgcctgcacagaggcctgcccttgcacctccatctaagccttctctgaaagactcaggctcaagaaacccctgcccatctgcacccacctgggccaggccaaagccggaggagtgaggagcccccaccgttctcagcaatccctgtcaccatctcatcaccaggagtgactctgcccatactcggacccctgggaccagcccttcagccaccggtctcgacctctcctctcagcccttctgcaccctgggccttcacctgcaagctgaacaatgtccttactgggaataactggttttccttttgaatcttaagaaaatttgtctggctacactctttaagcaccttcctgagccacccgtggccaggctctgctggccgcatctgcctggccccatctaccttccctggaagcacaggactcaccccaggggtctcacaggaacatgcccagtgctttcaaacccagtaaaattttacttagattttgaca

SEQ ID NO: 149630 - DNA, 3126 bp, Homo sapiens
  Payload ID: 9554
  Gene Symbol:
  Gene Name: Long-chain-fatty-acid--CoA ligase 6  [Source:UniProtKB/Swiss-Prot
  Acc:Q9UKU0]
  Uniprot ID: Q9UKU0
  ENST ID: ENST00000413683
  CDS Start-End: 54-2057
gccttatctgactcttgttttcaacagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggacctaccacagtgcttaatacagattaaggtgttcagtaaatattgattcaatgactcaaaacccgaggtaaaaccaggttcgaagagaaaaggcaaagtgcacggcttgtcgaagattgcagagaaagcagagcggagcaggcagggaggtagcggctctgggccgttcagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagaaaacaaattccagtactcctggtaagaaaaacagaggccttttaacaagtactccatcttcagagacagctggttttgtgattgatttgtcctcagtgcaaaaagcatcttttgaagaactatttccaaatgtcagcaattatgttaattcaaatgaaattgttcctgtgtcaagtttgcaggaaaattcttcaaatgagtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaa

SEQ ID NO: 149631 - DNA, 1230 bp, Homo sapiens
  Payload ID: 9555
  Gene Symbol: LOR
  Gene Name: loricrin
  Uniprot ID: P23490
  ENST ID: ENST00000368742
  CDS Start-End: 58-996
cttctctcctcactcacccttcctggtgctttgggctctccttccttctcagacaagatgtcttatcagaaaaagcagcccacccctcagcccccagtggactgcgtgaagacctctggcggcggtggcggtggcggcggcagcggcggtggtggctgcggcttcttcggcggcggcggctcagggggcggtagcagcggttctggctgcggctactccggcggcggtggctactctggcggcggctgcggcgggggctcctccggcggcgggggcgggggcggcattggaggctgcggagggggctccggtgggagcgtcaagtactccggaggcggcggctcctccggcgggggctctggctgtttctccagcggtgggggcggctccggctgcttctcctccggtggcggcggctcctccgggggcggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggctgcggcggaggctcctctggcggcagcggctccggctacgtctcctcgcagcaggtcactcagacctcgtgcgcgccccagccgagttacggaggggggtcgtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattcatgag

SEQ ID NO: 149632 - DNA, 5337 bp, Homo sapiens
  Payload ID: 9556
  Gene Symbol: LDLR
  Gene Name: low density lipoprotein receptor
  ENST ID: ENST00000252444
  CDS Start-End: 1-2837
aggggaggcctggcgttcctccgcggttcctgtcacaaaggcgacgacaagtcccgggtccccggagccgcctccgcgacatacacgagtcgccctccgttatcctgggccctcctggcgaagtccccggtttccgctgtgctctgtggcgacacctccgtccccaccttgtcctggggggcgccctcgccccaccagccccgatcaagttcacagaggggcccccggccaccctcaaggcctcggttccttacgaggttgaaacgttgcctcagaatctccccgcccctccttggtctgcagccgagatcttcagccacgtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaa

SEQ ID NO: 149633 - DNA, 2333 bp, Homo sapiens
  Payload ID: 9556
  Gene Symbol: LDLR
  Gene Name: low density lipoprotein receptor
  Uniprot ID: P01130
  ENST ID: ENST00000455727
  CDS Start-End: 87-2165
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtctgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggctt

SEQ ID NO: 149634 - DNA, 2429 bp, Homo sapiens
  Payload ID: 9556
  Gene Symbol: LDLR
  Gene Name: low density lipoprotein receptor
  Uniprot ID: P01130
  ENST ID: ENST00000545707
  CDS Start-End: 87-2135
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtcctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctc

SEQ ID NO: 149635 - DNA, 2768 bp, Homo sapiens
  Payload ID: 9556
  Gene Symbol: LDLR
  Gene Name: low density lipoprotein receptor
  Uniprot ID: P01130
  ENST ID: ENST00000535915
  CDS Start-End: 87-2546
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgctcccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggccc

SEQ ID NO: 149636 - DNA, 3144 bp, Homo sapiens
  Payload ID: 9556
  Gene Symbol: LDLR
  Gene Name: low density lipoprotein receptor
  Uniprot ID: P01130
  ENST ID: ENST00000558013
  CDS Start-End: 72-2648
gccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgt

SEQ ID NO: 149637 - DNA, 928 bp, Homo sapiens
  Payload ID: 9556
  Gene Symbol: LDLR
  Gene Name: low density lipoprotein receptor
  ENST ID: ENST00000560467
  CDS Start-End: 1-928
gcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactg

SEQ ID NO: 149638 - DNA, 2941 bp, Homo sapiens
  Payload ID: 9556
  Gene Symbol: LDLR
  Gene Name: low density lipoprotein receptor
  ENST ID: ENST00000557933
  CDS Start-End: 88-2934
agtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgccacggagctgggtctctggtctcgggggcagctgtgtgacagagcgtgcctctccctacagtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataa

SEQ ID NO: 149639 - DNA, 605 bp, Homo sapiens
  Payload ID: 9556
  Gene Symbol: LDLR
  Gene Name: low density lipoprotein receptor
  ENST ID: ENST00000559340
  CDS Start-End: 1-512
ggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatgg

SEQ ID NO: 149640 - DNA, 3617 bp, Homo sapiens
  Payload ID: 9556
  Gene Symbol: LDLR
  Gene Name: low density lipoprotein receptor
  Uniprot ID: P01130
  ENST ID: ENST00000558518
  CDS Start-End: 188-2770
ctcttgcagtgaggtgaagacatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgta

SEQ ID NO: 149641 - DNA, 2940 bp, Homo sapiens
  Payload ID: 9557
  Gene Symbol: LDLRAP1
  Gene Name: low density lipoprotein receptor adaptor protein 1
  Uniprot ID: Q5SW96
  ENST ID: ENST00000374338
  CDS Start-End: 120-1046
gcggcggagctggcgctgggaggggaggagcgcgcagcccgcgcgccgcagggccgggcggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcaagctgcctgagaactggacagacacgcgggagacgctgctggaggggatgctgttcagcctcaagtacctgggcatgacgctagtggagcagcccaagggtgaggagctgtcggccgccgccatcaagaggatcgtggctacagctaaggccagtgggaagaagctgcagaaggtgactctgaaggtgtcgccacggggaattatcctgacagacaacctcaccaaccagctcattgagaacgtgtccatatacaggatctcctattgcacagcagacaagatgcacgacaaggtgtttgcatacatcgcccagagccagcacaaccagagcctcgagtgccacgccttcctctgcaccaagcggaagatggcacaggctgttaccctcaccgtagcccaggccttcaaagtcgcctttgagttttggcaggtgtccaaggaagagaaagagaagagggacaaagccagccaagagggaggggacgtcctgggggcccgccaagactgcaccccctccttgaagagcttggtcgccactgggaacctgctggacttagaggagacagctaaggccccgctgtccacggtcagcgccaacaccaccaacatggacgaggtgccgcggccacaagccttgagtggcagcagtgttgtctgggagctggatgatggcctggatgaagcgttttcgaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaacaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatcgctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccacgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 149642 - DNA, 785 bp, Homo sapiens
  Payload ID: 9558
  Gene Symbol: LDLRAD1
  Gene Name: low density lipoprotein receptor class A domain containing 1
  Uniprot ID: Q5T700
  ENST ID: ENST00000371360
  CDS Start-End: 19-636
cagcaggaaaccgaagacatgaacaaggtcttcccccagggagagaatggctacactgctgctgaatccaaagcccaccctggaggggaagcaggcggcggccacctctgctgctcacgtcgcggggcctgcctctctgcctctctgctgctcctcctggcaactgtggcggccctcatcgccttggtcaccattcttggactcccatcatgcaccccaggagcccaagcttgtataacactgacaaacaggacaggcttcttgtgccatgaccagaggagctgcattccagccagtggggtctgtgatggcgttcgcacctgtacccacggcgaggacgaggatgagagcttgtgccgagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaatggcactgataacccttcacatgaaaatcaaatcctagcgcacaagggcaggaagcagcctttgaaatgggatctacacatcatttctgaataggaattttctctcctcctt

SEQ ID NO: 149643 - DNA, 654 bp, Homo sapiens
  Payload ID: 9558
  Gene Symbol: LDLRAD1
  Gene Name: low density lipoprotein receptor class A domain containing 1
  Uniprot ID: Q5T700
  ENST ID: ENST00000371362
  CDS Start-End: 61-411
agggaacccgtgctgagctctctgcacacagccccagtcgggcagcaggaaaccgaagacatgaacaaggtcttcccccagggagagaatggctacactgctgctgaatccaaagcccaccctggaggggaaggagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaatggcactgataacccttcacatgaaaatcaaatcctagcgcacaagggcaggaagcagcctttgaaatgggatctacacatcatttctgaataggaattttctctcctcctttcaagttgttcagcctctgcttgaatgcttccaatgaccaggagctcattaccatgttaggtggcttctaacaaagatgatgtggtggaacccc

SEQ ID NO: 149644 - DNA, 2194 bp, Homo sapiens
  Payload ID: 9558
  Gene Symbol: LDLRAD1
  Gene Name: low density lipoprotein receptor class A domain containing 1
  Uniprot ID: Q5T700
  ENST ID: ENST00000420619
  CDS Start-End: 11-511
cttggtgacaatgcagggaacccgtgctgagctctctgcacacagccccagtcgggcagcaggaaaccgaagacatgaacaaggtcttcccccaggagcccaagcttgtataacactgacaaacaggacaggcttcttgtgccatgaccagaggagctgcattccagccagtggggtctgtgatggcgttcgcacctgtacccacggcgaggacgaggatgagagcttgtgccgagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaatggcactgataacccttcacatgaaaatcaaatcctagcgcacaagggcaggaagcagcctttgaaatgggatctacacatcatttctgaataggaattttctctcctcctttcaagttgttcagcctctgcttgaatgcttccaatgaccaggagctcattaccatgttaggtggcttctaacaaagatgatgtggtggaaccccgtctctaccaaaaatacaaaaattagccaggcatggcggtgcacacctatagtcccagctactagggaggctgaggtgggaggactgtgtgaacccaggaggtcaaggctgcagtgagctgtgaccacaccactgcactccagcctgagcaacacagtgagaccctgtctcaaaaaaaaaatgaaacaaaacacaaacacaaacaaagacgaagggaatctgcttccatgatttcatgcctgtctctggggccacacagaggaaatctgctaactgctccaaggcatacttgtggatcctaatctcgtcatcccttagagtgatgacatgtctggggcttaaatgacaagccgagtttagccttcatggatggcacatacgtgaaacatatgccacttcctacccctttggtacctaaggcagatatactgggcttggatgcaactttagcatcttccccagtttagttaacccagcaggctctactgatttaaccaagtgacacagcacatgaaacaggatatctggcatcctaccagtgggaagccaccccaggaagctctgagctgtagaatagaagatctggagaaagagcagcttgaagggctcctcaccagtcttctgtctgtccaacctgctctccaccccagcactccccaccctccactctatgcccagctgcccgcctaaacagcccagttttctggaagtagggactatattttgatcctggagcctgaatgagctgcttctgtgcttatctttccagcttcacaccacccaggcaggcaaggatgaatatttccattagatggatgagaaaactgaggcccagagagggcgatgacttgtccagaatcatagagcaaagtcagcgctggaactggaacccaaatacagcctatggcaccccagcccagaaggctttccagctaccagtgtgattataccttggccagggcagtctctgcggggtattttaaaagtgagcttgtcaggtgcactggctcatgcctatgatcccagcactttgggacactgaggtggaagtgtcccacttgagcccaggagttcgagaccagcctgggcaacatagggagaacctgtctctacaaaaaataggaaaaaagtagctgggtggggtggtgcatgcttgtagtcccagccactcagaaagctaagatgggaggatcgtttgagcctgggagattgaggctgcaatgaggcatgatcatgccactgcactccagcctgggcaacaaaccctgtctcaaaaaatttctttttaataaaaataaaataaaacatgagattgagggtcagcaagtgtgacacccatattctgaaagagagacttgggatctgcctgatgggagggctcctgtcgagggagacagacatatccccactgaaaaattaataaaattggttttacatatc

SEQ ID NO: 149645 - DNA, 2246 bp, Homo sapiens
  Payload ID: 9558
  Gene Symbol: LDLRAD1
  Gene Name: low density lipoprotein receptor class A domain containing 1
  Uniprot ID: Q5T700
  ENST ID: ENST00000545928
  CDS Start-End: 75-563
cttggtgacaatgcagggaacccgtgctgagctctctgcacacagccccagtcgggcagcaggaaaccgaagacatgaacaaggtcttcccccagggagagaatggctacactgctgctgaatccaaagcccaccctggaggggaaggagcccaagcttgtataacactgacaaacaggacaggcttcttgtgccatgaccagaggagctgcattccagccagtggggtctgtgatggcgttcgcacctgtacccacggcgaggacgaggatgagagcttgtgccgagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaatggcactgataacccttcacatgaaaatcaaatcctagcgcacaagggcaggaagcagcctttgaaatgggatctacacatcatttctgaataggaattttctctcctcctttcaagttgttcagcctctgcttgaatgcttccaatgaccaggagctcattaccatgttaggtggcttctaacaaagatgatgtggtggaaccccgtctctaccaaaaatacaaaaattagccaggcatggcggtgcacacctatagtcccagctactagggaggctgaggtgggaggactgtgtgaacccaggaggtcaaggctgcagtgagctgtgaccacaccactgcactccagcctgagcaacacagtgagaccctgtctcaaaaaaaaaatgaaacaaaacacaaacacaaacaaagacgaagggaatctgcttccatgatttcatgcctgtctctggggccacacagaggaaatctgctaactgctccaaggcatacttgtggatcctaatctcgtcatcccttagagtgatgacatgtctggggcttaaatgacaagccgagtttagccttcatggatggcacatacgtgaaacatatgccacttcctacccctttggtacctaaggcagatatactgggcttggatgcaactttagcatcttccccagtttagttaacccagcaggctctactgatttaaccaagtgacacagcacatgaaacaggatatctggcatcctaccagtgggaagccaccccaggaagctctgagctgtagaatagaagatctggagaaagagcagcttgaagggctcctcaccagtcttctgtctgtccaacctgctctccaccccagcactccccaccctccactctatgcccagctgcccgcctaaacagcccagttttctggaagtagggactatattttgatcctggagcctgaatgagctgcttctgtgcttatctttccagcttcacaccacccaggcaggcaaggatgaatatttccattagatggatgagaaaactgaggcccagagagggcgatgacttgtccagaatcatagagcaaagtcagcgctggaactggaacccaaatacagcctatggcaccccagcccagaaggctttccagctaccagtgtgattataccttggccagggcagtctctgcggggtattttaaaagtgagcttgtcaggtgcactggctcatgcctatgatcccagcactttgggacactgaggtggaagtgtcccacttgagcccaggagttcgagaccagcctgggcaacatagggagaacctgtctctacaaaaaataggaaaaaagtagctgggtggggtggtgcatgcttgtagtcccagccactcagaaagctaagatgggaggatcgtttgagcctgggagattgaggctgcaatgaggcatgatcatgccactgcactccagcctgggcaacaaaccctgtctcaaaaaatttctttttaataaaaataaaataaaacatgagattgagggtcagcaagtgtgacacccatattctgaaagagagacttgggatctgcctgatgggagggctcctgtcgagggagacagacatatccccactgaaaaattaataaaattggttttacatatc

SEQ ID NO: 149646 - DNA, 4012 bp, Homo sapiens
  Payload ID: 9559
  Gene Symbol: LDLRAD2
  Gene Name: low density lipoprotein receptor class A domain containing 2
  Uniprot ID: Q5SZI1
  ENST ID: ENST00000344642
  CDS Start-End: 188-1006
ctgaaccaaatgaagaggatctggaaggcaaagcactaagatcatagtgaagacttgcctcccccttctccttgtgtcccaccagcctccctgctggcctgaccaggccccatactccagtctccccagagaccccaagctgaagattctgtgggtctgccccattgctgggcacagcagagcctggatggaggcttgttgtcttctgcagttgccccaaaggttgctcttgctgggggcagccgccctgactgcaactgctttggagacagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctctttccgtctgggaccttgtggtgcctacttccgctgccagaatggcaggtgcatcccctcaagcctcgtgtgtgacccctggggcatggacaactgtggcgatggcagtgaccagggctcctggtcaccagctgactgcagaggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggctccactgagtgaagccctcatcaaagactcaggaggcccctggcggggatagcaccgtttattaagaaaaatcaagacaaagaccacaggagggtcccttctaggacacagaggccaggcgtcccaaccccacagtctgggggccactggcaggatggcacttgagctggatcttcaggctcctgcagatggggcagggtggtcatatccccctcctctctctctcagtcgtgagtcctgccttcccccacctaaggcactagctcttcctgagcaccagcggcatccgtccgtccgttgtctgttggaggagtccctgggccttcacttccagatgggtggggatgtggcctggggtgggcggggcccggtgggcggggccctatcagtgctgggctctgcctgtagcagctcctggtaagagttggggtgggccttcccttacagcccctgagggagggaccccaggctgtgtgctggcaggagggggtgggaatgcaggccaggaggacgtggtaggagggggagtctgccagaggaggtgccaggggctgggtggaggtgggtgggggtgctgaaaaacgagctggtggggatggggaccgcctgcccaggggtgagctgccttttgctccacagccggcactaaagacaattcccaatcctgagtgggtggcagagactcctgcgatgcccgtctcaggtagctgtggggcaccagcccacaagccgaggttggctctcctaggagtgagaactgcccaagggctgcagaaacaggccacccagctctatctgggggctccatcggtgggtagggggacagtgggggcagttctgggcccacccagccactgttcctgaccccaagtcctggtgactttctgaggtgcccactcccatccaacctgccttgctggccagccttgtggctttgcccagctgtgtgtgtgagggtggcatgcccacctccagtccagcccagggcggtagcagcaaagcgtggcatcgcctcggtttcttacaaaaattcataataatattaataataatatactcgacattgtcgggctggggcgtggcccgggagtccgtgtggggcaggcaggtgcctacgaggggcaggggcgtgtgttggccccggcctgggcgcggtgctgcaggtccaggggctgtgggggcggggcgccgggtcgggccgagtgcagcaccaggttcttgacacagcctgtgatgcctgaggagaatctgcccccggtcagcgtggccacgtcaggggctccgcctgccgggaggtgagaggacagggcctgtgggctccagcagcccaggaggcgaggaaggctgggcgagctctagccctaagggagtgccgttcctgcccctgccctgagaaggagccccagacttaccgatgtagacgctgcccttggcgttgactgccacgttgggacctggggaccggccgctgaccagctcctcaccgtcgacttggatggaacctctgcggccctccctgcagtggaactgggtcaggcccctttccacaaacttcctggtcctccccggccccacgacagagtcccctccctctgatatcgagactccagactcagaagtctgtccctgtttcccaagctctttctttcccccgctgaacgagagatcgggccccacaaacacagcttcctcatttctgcacccaggtttcctcccactcctggggcactcgcctgcccccagcggagttcagtccgagatggaagcccgagccctggctggtgggttctcccctcccctggcttcaagttctgtctccacagagctcaatacctgcctctctgcccatggtagggggcgtcctgccccactccagaacgctgggccccatcccgagtgcccggcagggtcccttaccgcagtgctgtcacccggtgccactcgccgtcattgatggggtcctcagagaccaggcgggcctccccactacccagctggtacctgcagtcatccaggcccaagaagtatgagctggggcaggaccggggggtggggtgctgggaccagggaagggagaggaagggccaggtgccaggacctacctgaagacaaggtgcccgtcttgaagcccgaggctgatgaagtccttgccttggccggcctctcccacctcctgccagggaagcacagggtctctggggtccccagcctggagagcagaggctgccgaggccagggggctctgctttcccctccccccaccactccggccaccaggaagccagcttcctgccccaggagccccaagagcccagccggatacccacactcaccacaccctgccagagcaggaggccactggctgtgctggtccgaacctccagctcgatggtctcgggcacctcgggcaggctgcggaggaagagcgggtgaggggacagaagtcccagattcccatcctccccattaggcccatgggcccttccaatgccagtctcacctcctggagaagacatggccagggaaggcgaggaagccatcatcgtggaaataggctccgtactgcccaggggcatctgtgggagagaggagggtggtgccatacctgctgcatcaggcatcaaaatcccccgtcagttcccctgacccccacctccacgccaacatgcaggactagggggctccgagcctgcagtccctggggacccacgggggctgccaacagaattcagggagcctatgaccttggatgggaaagcattacacctcaatttcactcacttctcactgaaattgagcagttctttcaatgagatgtaggcaagaaaccaaagtagcagtggtaggacctgcaactttgttactagtatttgcttatcacatgacagtagctgcaaatatttcaaaatatcatttacacatattgctgctttgaaattgtggtagctactgagatcaccagatcttgttatttgatgtgttaataaagaagcacatatatagcaagtcaggaaactt

SEQ ID NO: 149647 - DNA, 1180 bp, Homo sapiens
  Payload ID: 9559
  Gene Symbol: LDLRAD2
  Gene Name: low density lipoprotein receptor class A domain containing 2
  Uniprot ID: Q5SZI1
  ENST ID: ENST00000543870
  CDS Start-End: 90-908
ctgaccaggccccatactccagtctccccagagaccccaagctgaagattctgtgggtctgccccattgctgggcacagcagagcctggatggaggcttgttgtcttctgcagttgccccaaaggttgctcttgctgggggcagccgccctgactgcaactgctttggagacagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctctttccgtctgggaccttgtggtgcctacttccgctgccagaatggcaggtgcatcccctcaagcctcgtgtgtgacccctggggcatggacaactgtggcgatggcagtgaccagggctcctggtcaccagctgactgcagaggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggctccactgagtgaagccctcatcaaagactcaggaggcccctggcggggatagcaccgtttattaagaaaaatcaagacaaagaccacaggagggtcccttctaggacacagaggccaggcgtcccaaccccacagtctgggggccactggcaggatggcacttgagctggatcttcaggctcctgcagatggggcagggtggtcatatccccctcctctctctctcagtcgtttcctcccactcctggggcactcgcctgcccccagcggagttcagtccgaga

SEQ ID NO: 149648 - DNA, 3798 bp, Homo sapiens
  Payload ID: 9560
  Gene Symbol: LDLRAD3
  Gene Name: low density lipoprotein receptor class A domain containing 3
  Uniprot ID: Q86YD5
  ENST ID: ENST00000315571
  CDS Start-End: 22-1059
agcgggagcggcggccgcgccatgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaagggtgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgttggagagacagcatataaaacagtattgaaataggctgggagagagcaatgtttctgtgctatattggatgctcagaagtgcaggagacgctggacccaattctctctgctgggtagttaccttatagcatttggggatttgggttagatgatctaaccaggaggccatcactggatggtcacccccccaaaaaaattccatttgagcatcaaaacctgctttgcacaatcctatttgatgcccccagttcagcagagtcagtggccaaagaaaactttggacgtgagtaacacccttcagcagtcgcaacgttattttggttttgtgaaggactctgaaaccatctaccctgtataaattctggctttagaaatttgcccaagaatgctcattctgagagctttcctcagcagcatatatcatcagcctcatcctaaaataggcagggagcccctcccatgagtttatccaagttctcagctcctaaaatgcaggctgccaagaccctacacctgccctggctctacagccacttacctggtttctggactgtcaccctcccagctgacctgcccgtagccaaggaatgaggacctaacttgagttggcccaaagtctgacctggctgtatgtccctgtggcccacacccagcctgtcttgctcattcatgcagcctcaacactggcctccaaagttcccttaacacttgcaaagtcctttttacctgtgcatttggacttgaggacactggtttctatcacaggtgagagccatgttcaatacctccagcaagctctcctggctccctgcactgtgcacgctcctcttcccaaggtcccaataccagcacctctagttagagttagggtcagggtcaggcctctcccaacatcccagtagtttctcctctgagacacatgggcaagagacaatttggagtcaagattttccatttggatctattttaaatcttttagaaatgcatttgaaacagtgtgtttgttttttcccttctagttaagggactatttatatgtgtataggaaagctgtctctttttttgtttttcctttaacaaggtccaaagaaagatgcaaaaggagatcacacccttgccccgctgagccccgtgataacaagtcactccagactaacctgtgtgccagacatttgtgcattgttgcactttgaggttattatttatcaagttcttgaaggaagcagaaagagggactcctctctccctccgtgtatagtctctatgtttgtgctagtttttcttttttttctctgtgtccagtcagccacagggcccgcctccctgcaggaataaggggtaaaacgttaggtgttgtttggcaagaaaccacactgactgatgaggggtaaaatggaaccaggtagagccactccgggcagctgtcacccattcagaacttctttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccactggtattttgttttgtttaaaaaaaaaaagaaagaaagaaagaaagaaaaacggaaaggaacctagctgcctgtatctttcatttttaaaatagcacttgagttattttctgagtaatccaataaagaacttttgatgacagccagaatgtgttagaactctggctgaacatttcatctcctgtgagtcagaagggctttatttctccctttgatggggccccttcttctttctggtgctctggaagttgtttagaggaaagaattctaattttaattaattgcgcagtgagttaatctcactcgcttttctgcttccaggcatcttaggaaaaacaaatggttttagtagataagggatgcctactaatgcttttttaaaacaaacagggacatttttattatagatttgatttttttaatgaatgtttttaaaaatatataaataggacaccaaagcggcagggtttttttgggggggagggggtttgttttccaactcaagatggcacattagtggccagcaatattttttaactcattccaaccaggaagcttttttatacattgcctaaatctacgccaaccagaaaatagtctcatctctttttttctcaaatgagatccgtgttttattttagcattaaattagttacactgtgatgactggcctattacctgactcagctccctctaccttgaaattgacatttttaaaaaatgcaactaagtggttaatagtgtgtgacgctcaaagttaatgtaaactggaaaggttgtgtgtcgttgctttttgtgttttggttaggcttggttttgttttttaatttttatactttctaataaatttgcagtttcattctt

SEQ ID NO: 149649 - DNA, 1879 bp, Homo sapiens
  Payload ID: 9560
  Gene Symbol: LDLRAD3
  Gene Name: low density lipoprotein receptor class A domain containing 3
  Uniprot ID: Q86YD5
  ENST ID: ENST00000528989
  CDS Start-End: 119-1009
gaaggcgggagggaggagggccaggcgggagggcggggacggcgcggcgaggggcggggtcagcgccgaggccgcgggggcagcaacgacgccgggcagcgggagcggcggccgcgccatgtggctgctggggccgctgtgcctgctgctgagcagcgccgcggccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaagggtgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgttggagagacagcatataaaacagtattgaaataggctgggagagagcaatgtttctgtgctatattggatgctcagaagtgcaggagacgctggacccaattctctctgctgggtagttaccttatagcatttggggatttgggttagatgatctaaccaggaggccatcactggatggtcacccccccaaaaaaattccatttgagcatcaaaacctgctttgcacaatcctatttgatgcccccagttcagcagagtcagtggccaaagaaaactttggacgtgagtaacacccttcagcagtcgcaacgttattttggttttgtgaaggactctgaaaccatctaccctgtataaattctggctttagaaatttgcccaagaatgctcattctgagagctttcctcagcagcatatatcatcagcctcatcctaaaataggcagggagcccctcccatgagtttatccaagttctcagctcctaaaatgcaggctgccaagaccctacacctgccctggctctacagccacttacctggtttctggactgtcaccctcccagctgacctgcccgtagccaaggaatgagg

SEQ ID NO: 149650 - DNA, 1996 bp, Homo sapiens
  Payload ID: 9560
  Gene Symbol: LDLRAD3
  Gene Name: low density lipoprotein receptor class A domain containing 3
  ENST ID: ENST00000524419
  CDS Start-End: 119-1126
gaaggcgggagggaggagggccaggcgggagggcggggacggcgcggcgaggggcggggtcagcgccgaggccgcgggggcagcaacgacgccgggcagcgggagcggcggccgcgccatgtggctgctggggccgctgtgcctgctgctgagcagcgccgcggccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagtctcactcttgttgcccaggctggagtgcagtggcacaatctcggctcactgcaagctccgcctcccaggttcacgccattctcctgcctcagcctcccgagtagctggaactacagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaagggtgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgttggagagacagcatataaaacagtattgaaataggctgggagagagcaatgtttctgtgctatattggatgctcagaagtgcaggagacgctggacccaattctctctgctgggtagttaccttatagcatttggggatttgggttagatgatctaaccaggaggccatcactggatggtcacccccccaaaaaaattccatttgagcatcaaaacctgctttgcacaatcctatttgatgcccccagttcagcagagtcagtggccaaagaaaactttggacgtgagtaacacccttcagcagtcgcaacgttattttggttttgtgaaggactctgaaaccatctaccctgtataaattctggctttagaaatttgcccaagaatgctcattctgagagctttcctcagcagcatatatcatcagcctcatcctaaaataggcagggagcccctcccatgagtttatccaagttctcagctcctaaaatgcaggctgccaagaccctacacctgccctggctctacagccacttacctggtttctggactgtcaccctcccagctgacctgcccgtagccaaggaatgagg

SEQ ID NO: 149651 - DNA, 8486 bp, Homo sapiens
  Payload ID: 9561
  Gene Symbol: LDLRAD4
  Gene Name: low density lipoprotein receptor class A domain containing 4
  Uniprot ID: O15165
  ENST ID: ENST00000359446
  CDS Start-End: 469-1389
agcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 149652 - DNA, 8633 bp, Homo sapiens
  Payload ID: 9561
  Gene Symbol: LDLRAD4
  Gene Name: low density lipoprotein receptor class A domain containing 4
  Uniprot ID: O15165
  ENST ID: ENST00000399848
  CDS Start-End: 669-1535
gctgggtctccgagccccggaggaagcaggcgtgtgttgaatttctctctgcccctcaccttggaataaacaggaagcgacaagcacccagcccggcccggcacttgcctttgtgaaggggtctgccctgcacagcctttaggaagcttcctcgggaccccttcccggtgcgccgccccgggtgggcctgggggcgcgccctcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcataca

SEQ ID NO: 149653 - DNA, 743 bp, Homo sapiens
  Payload ID: 9561
  Gene Symbol: LDLRAD4
  Gene Name: low density lipoprotein receptor class A domain containing 4
  ENST ID: ENST00000587905
  CDS Start-End: 536-743
cagcagggccggtggccgcggagccgcactgcgggcagtccccgcctccgctccgggggggcggcccagcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatca

SEQ ID NO: 149654 - DNA, 685 bp, Homo sapiens
  Payload ID: 9561
  Gene Symbol: LDLRAD4
  Gene Name: low density lipoprotein receptor class A domain containing 4
  ENST ID: ENST00000586222
  CDS Start-End: 557-685
atttatttcctggttagtcctgcccatcttcccagtataaatagaacctccatgtgtgtgtgcgtgtgtgtgtgcgtgtgtgtgcgtgtgtgcatgtgtgtgcgtgtgtgtgtagaatgatgaccatgtgcttgctgccttgggggggatcttgactgtgaccttgcgtcctggtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgac

SEQ ID NO: 149655 - DNA, 2171 bp, Homo sapiens
  Payload ID: 9561
  Gene Symbol: LDLRAD4
  Gene Name: low density lipoprotein receptor class A domain containing 4
  Uniprot ID: O15165
  ENST ID: ENST00000587757
  CDS Start-End: 1242-2051
acacagcctgggggcatccgaatgcacgggagatgttttacactcagatgaaacaaactgtttagacctcggggaaaagagactgtgcttgaacaaaatgaaccaggagaaagcgccctcctgagacatgtctctgctttcatgtttgaattgcctgggattctgttctctaatttctgatccttataaactaaaactgcctaggaacattgagcatcctgactttgaaggagtctctgtggtgtttttgtgctaccatacatggggaataatgatgtgaggcagagggagagggaatgaatgggagagccaagagggaagagcgagccggggggaaaggagcgcgcagtgtttcctgctgcggttaggacctcacgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagc

SEQ ID NO: 149656 - DNA, 572 bp, Homo sapiens
  Payload ID: 9561
  Gene Symbol: LDLRAD4
  Gene Name: low density lipoprotein receptor class A domain containing 4
  ENST ID: ENST00000593236
  CDS Start-End: 469-572
aagaggggtgctgcccaccggaaacgatggcgcgaggccgcagagctaaatgggggcctctccagggagtgctctgttcacggctccatcgctgttaggaaggagcaaaagccccttgccatccctgtgtgacagcaatgaggtgaacccaggggccgaagcccacccagggagttgatgggtagctgggacgatgaaagcatcccaagacctcccttttccatctgtggctgatcacctctggaacccacagctagccggctgctcctccactatcagatggcggctgtcagtcatgggcttgtcaccgagtgcatccgtcatgctcgggccatgggccggcacctgtgtgtgtgtgtccagcttaacgacagagatttttggaaagacgccctaagatagacatacttgaaactgacggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgca

SEQ ID NO: 149657 - DNA, 1640 bp, Homo sapiens
  Payload ID: 9561
  Gene Symbol: LDLRAD4
  Gene Name: low density lipoprotein receptor class A domain containing 4
  Uniprot ID: O15165
  ENST ID: ENST00000592991
  CDS Start-End: 959-1585
gccgggcctcgggggcgcagccggactggacggcggctcctgtgggcacttggccgggtttgctggtttttcgggaaataaggccactggggacagtcactacgttttcaggaaccgctcagcccctctgagtgccccgcagatggacctggcggcgttcctggctacggctgactgggctcccggagcgaggagcgcccctgcgggcccagcctgggccctgggcggtgggagggcctccgcccccttcccgcttccgccccgctggcgccggacccccgccctcgtctgtgcctgccaggccgggcccttccctcccgtcacaggcggtccctgagcccacccttcgtctccgagcagctggaccgccgtatacgtttgccactgattccaggatgtccccgagtatcttaggaaagggccgtgttggacaaacgcggggctcggtgtttcttccgcgccgtccctcgctgctggcgccggggccgtcggaggctcagtgatggcccagcccgcccgtttccgagaattccccaaacgcgggcccctacacgctgagttcgcgctctcccgtgacggccgacagccccgcggaccctgctgacagccacactctgggctgaaaagggtaccacgcgtactttttttcccagcacgcgtggggccttggaaagaacctttactgaggcctgtggctggcctgtcaccttgtcaatctggccaaacgtttttgaaaaaggatgctaactcaccagatgtgaagttgcatctgccctgtgaataggtggactggagaagacactcgctggaggatcctgagcccaggctcggaaagggccgtccacctgcgagcgcggacttgcgcctctgctggaggccgggcagggcacgggcgggccccgggccacctctgccagggcttcctcaacccagcctgccctcatcgggcggccactgaatgcggttggacagtcatcttgaatgtatttcaagcacacaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgc

SEQ ID NO: 149658 - DNA, 2118 bp, Homo sapiens
  Payload ID: 9561
  Gene Symbol: LDLRAD4
  Gene Name: low density lipoprotein receptor class A domain containing 4
  Uniprot ID: O15165
  ENST ID: ENST00000585931
  CDS Start-End: 352-1041
atgggagagccaagagggaagagcgagccggggggaaaggagcgcgcagtgtttcctgctgcggttaggacctcacgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttgcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaa

SEQ ID NO: 149659 - DNA, 844 bp, Homo sapiens
  Payload ID: 9561
  Gene Symbol: LDLRAD4
  Gene Name: low density lipoprotein receptor class A domain containing 4
  Uniprot ID: O15165
  ENST ID: ENST00000586765
  CDS Start-End: 87-842
agaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgatt

SEQ ID NO: 149660 - DNA, 14897 bp, Homo sapiens
  Payload ID: 9562
  Gene Symbol: LRP1
  Gene Name: low density lipoprotein receptor-related protein 1
  Uniprot ID: Q07954
  ENST ID: ENST00000243077
  CDS Start-End: 467-14101
cagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagaagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaagttggcaccaacaaatgccgggtgaacaatggcggctgcagcagcctgtgcttggccacccctgggagccgccagtgcgcctgtgctgaggaccaggtgttggacgcagacggcgtcacttgcttggcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcagcccgcacctgcccccccaaccagttctcctgtgccagtggccgctgcatccccatctcctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcgaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctggaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggaagctctactggaccgatggtgacaacatcagcatggccaacatggatggcagcaatcgcaccctgctcttcagtggccagaagggccccgtgggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctggaccataagggcaccaacccctgcagtgtcaacaacggtgactgctcccagctctgcctgcccacgtcagagacgacccgctcctgcatgtgcacagccggctatagcctccggagtggccagcaggcctgcgagggcgtaggttcctttctcctgtactctgtgcatgagggaatcaggggaattcccctggatcccaatgacaagtcagatgccctggtcccagtgtccgggacctcgctggctgtcggcatcgacttccacgctgaaaatgacaccatctactgggtggacatgggcctgagcacgatcagccgggccaagcgggaccagacgtggcgtgaagacgtggtgaccaatggcattggccgtgtggagggcattgcagtggactggatcgcaggcaacatctactggacagaccagggctttgatgtcatcgaggtcgcccggctcaatggctccttccgctacgtggtgatctcccagggtctagacaagccccgggccatcaccgtccacccggagaaagggtacttgttctggactgagtggggtcagtatccgcgtattgagcggtctcggctagatggcacggagcgtgtggtgctggtcaacgtcagcatcagctggcccaacggcatctcagtggactaccaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggactcatgccaacggctctatcaagcgcgggagcaaagacaatgccacagactccgtgcccctgcgaaccggcatcggcgtccagcttaaagacatcaaagtcttcaaccgggaccggcagaaaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaaacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgaactctctccatgccgaatcaacaacggtggctgccaggacctgtgtctgctcactcaccagggccatgtcaactgctcatgccgagggggccgaatcctccaggatgacctcacctgccgagcggtgaattcctcttgccgagcacaagatgagtttgagtgtgccaatggcgagtgcatcaacttcagcctgacctgcgacggcgtcccccactgcaaggacaagtccgatgagaagccatcctactgcaactcccgccgctgcaagaagactttccggcagtgcagcaatgggcgctgtgtgtccaacatgctgtggtgcaacggggccgacgactgtggggatggctctgacgagatcccttgcaacaagacagcctgtggtgtgggcgagttccgctgccgggacgggacctgcatcgggaactccagccgctgcaaccagtttgtggattgtgaggacgcctcagatgagatgaactgcagtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgtgaaacgccccagatgccctctgaattacttcgcctgccctagtgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactgacgaggaaccgtttctgatcttcgccaaccggtactacctgcgcaagctcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaa

SEQ ID NO: 149661 - DNA, 2169 bp, Homo sapiens
  Payload ID: 9562
  Gene Symbol: LRP1
  Gene Name: low density lipoprotein receptor-related protein 1
  Uniprot ID: Q07954
  ENST ID: ENST00000338962
  CDS Start-End: 250-1128
gcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcacctgtgtgtgttttcgaaatcacaacaggaaatggggtagtgatttgtctagaggggaggcaaagaaggggcagacagcagtccctctgagtctaatgaactggctgctgctgctggaaggggtgctacctccccactgtgctgggcacccctggaccctctcagcctcccaccctgcctacaaagcacttccagacttcacatgtgaaagctaaccatgcccatccttggcctttctgacccatgggatgccaggctgtttggggaggggtggctctagccaccccactctttggccttaggccccctgcatcctggcacttttgcttcccattcctgttctgagtttcctaatcatttaacagctcactcttgctcctcctctctcctggcccgggccagccctgtgtctcccggcccagatccagccctgtcctctcctcccccgctgtctccttgaaattgcctctccacccagactgctcccagcactccccttgctgttttcaagccaaaggaagtaacttaagcaagagagatgtgttttagagcccggcaaggatttctcaatagagggaagaccctaagatgggctgagtggaatccaggcatcatccctgggatctaggtcgaaatgcctcttggggacctaagccaggcaggggaaggtagcaggacataaccacaggctggaatcacaggcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaata

SEQ ID NO: 149662 - DNA, 550 bp, Homo sapiens
  Payload ID: 9562
  Gene Symbol: LRP1
  Gene Name: low density lipoprotein receptor-related protein 1
  ENST ID: ENST00000555124
  CDS Start-End: 1-550
aatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctggatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacg

SEQ ID NO: 149663 - DNA, 1693 bp, Homo sapiens
  Payload ID: 9562
  Gene Symbol: LRP1
  Gene Name: low density lipoprotein receptor-related protein 1
  ENST ID: ENST00000553277
  CDS Start-End: 473-1363
ggggaacagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccgcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaata

SEQ ID NO: 149664 - DNA, 418 bp, Homo sapiens
  Payload ID: 9562
  Gene Symbol: LRP1
  Gene Name: low density lipoprotein receptor-related protein 1
  ENST ID: ENST00000554118
  CDS Start-End: 1-418
cccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgaactctctccatgccgaatcaacaacggtggctgccaggacctgtgtctgctcactcaccagggccatgtcaactgctcatgccgagggggccgaatcctccaggatgacctcacctgccga

SEQ ID NO: 149665 - DNA, 2175 bp, Homo sapiens
  Payload ID: 9562
  Gene Symbol: LRP1
  Gene Name: low density lipoprotein receptor-related protein 1
  ENST ID: ENST00000554174
  CDS Start-End: 57-1376
ggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctggtgagggagctactgtctgaggttttgtgggggaaccatgatccagggccttctggtgaggggggaagcctctgtaggggaaccgttctctgagtctcctggtaaagagcgtggatgccccaggcctctagtgggagtggggtgggcttgaatactgcagagaaaggacaagatacgggttccactgtgatgggaacagtcattttagaaacaccacttctgtttacttcctgtttctcatttgacccttataataacccctagctgatgaacagggaggtggttcagttccctttcagcagatgaaaaagcaggatcaaagaggttaggtgatttgcctgtgtttacaaagccgggtgatagcactggaacttgttctagaagccttgctggctcagaggtggcatctccattgtgggataattagtgtgagcaaccagcccagtttgcctaggactgtcccagttttagccctgaaagtctggtaagccagcaaacccttacctttgtcttaggcaaactaggacagttggccaccgcagataagctatgtgggtagtcaggggtgttacaggacttgcttggggcaagtgtgtcctcttagccctcataacagactaagaatgtcctctgtggacagagtttagagcccatctctaattcagtctaaaatcactaaagtgtctaacgagtgcctaattctgtgaaggacagggtttctgccctcaaggggtctgagtagagtgggtgagataagtccacaaatcactgtgccagacacggatagatagcagtgtcacggaggatgtatagaaggagaaaacatctctggttagaagattccataaattctttaaagacatgctctgtagaggatgagtgggatcttggt

SEQ ID NO: 149666 - DNA, 6886 bp, Homo sapiens
  Payload ID: 9563
  Gene Symbol: LRP10
  Gene Name: low density lipoprotein receptor-related protein 10
  Uniprot ID: Q7Z4F1
  ENST ID: ENST00000359591
  CDS Start-End: 692-2833
aaatgtggaagctgaagctgcaagtcaagggcccgtctgacaagtccggcagggccgggaaaggggttaaggcgagcaagtgggtgtggcccgtgcgttgattggcaggggtgggaccgggcttgtcacccgccccggctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaattttgcaaattagctgcgagcctgagccccgcctctgcccatctcagtctatgctcacctcatcccactcctccctgtggagccctttgcttggccctctacctcctgccctcttcctgttcatctcccaaccactgcactcttgatttttataccacacagaaggtaagaaaattctaggaaccctaaggatcaatcctctccattttcactcaaatgcctggggcccagctctgcaatgactgactccagggcctctttcctcactgccagcatagaagtcaggggagccagctgggccctgcggtcaggaaggttctcatttttggagcataccctgagcccagatcataggagcagctgtccctggtgggacacaggagtcatgactcctaccctccaccctccacacccaccaggcatttagcagtctgtcctatgcaagacagatgaattctcagccaggatacctcaaggcaggcaaaggtgagtggagggagaattcacaaacattcagggtgtgtggtgctggcatcaccatggccaaatccaagaggtcttcctggaagagggcccaaactggaaccaaaagaatgctgtcagcagttggaatagagctgtgaattctagacagggggagtgtccccagaacaagcaaacggaggagacaagagggcaagggttataggaaagaccctgggcctgagagcacaagcagcggccagagctgcagcgctggggtgggtgatggagggaatgattcgcaagcagtgttggaacccagcccctagtgagcaaagtgacagaagctgccccagagtttggaaggaagatcgaggcagaagatgtagaaggaagctgtgggggtgggagtgatgcctcaggaacaaaactgaggaattccctaacggacccagtccctggggaaagaggctcccctcaggctctccttgtctagccccacacctggcagagcctgtcacccagcctagccccacgcctggcagagcccatcacccagcctagccccacacctggtggagaggccctgttgattacaccctgtcagcctcctcaaacccagcactaattgcacaattttcctctcttctagtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaagataccagaactcagtccttaagaaacaaaattctgccaggcgcagtagctcacacctgtaatcccagcactttggaggggccaaggcaggcggatcgcttgaggccaagagttcaagaacagcctgggcaacatgatgaaaccctgtctctaccaaaaatactaaaaattagccagtctcacaacctggtctcaaaataaataaatagatttaaaaaaaaaatcatgggcctgaaccaagctccagacctcactaggaggggagaaggaccccccagccacacagcccaaggctgcagaagcacctaggtggttagagagtgagtgcctggatggggcgcagtggctcacacctgtaatcccagcactttgggaggccgaggcaggcggatcacgaggtcaagagatcaagaccatcctggccaacatggtgacaccgtgtctctactaaaaatacaaaaataagctgggcatggtggtgcgtgcctgtagtcccatctactcgggaggctgaagcaggagaatcacttgaacctgggaggcaaaggttgcagtgagctgagatcgcgccactgcactccagcctggcaacagagcgagacaagactccatctcaaaaaaaaaagtgagtgcccgatgatgccagattcttcatcacctgaagtgaacccacacaacagggctgggccatgggcatcataaaccccattttgcaagctcaggaggagctttagggaaatcagaagactggcccagtctctaccaagtggtggatttagagccggcatggcttcgttccaaatctcacccttgtcccaccattccatgggacctcccattcctgagggagcctggatacgggcaagtgcacaacccgggaggttgaggttacagtgagccatgatcgcaccactgcagtccagcccgagcaatagggtgagaccctccctctgaaaaaaataaaaatactcattttggaaggaagtcattctaaaatgttacacttgtcttcagcatatctgcaatataataattttctgcataactgaggatcattcacagaaaccaatggcttttctccagcagtgtcttctgaagttgtaacagtaggggcacggggagctatttgcttttatgctaaatgaccttagaccacttataaaatgcatatgagtgctttaaatgtta

SEQ ID NO: 149667 - DNA, 1780 bp, Homo sapiens
  Payload ID: 9563
  Gene Symbol: LRP10
  Gene Name: low density lipoprotein receptor-related protein 10
  Uniprot ID: Q7Z4F1
  ENST ID: ENST00000546834
  CDS Start-End: 1-1671
atgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctgtgagcaagagcctgaggaagtagcagagaggggtgtgggcccatgtgcagttctgggaccctggcaccttggctcagggaagacccgagctcctttcactgcagaccctctc

SEQ ID NO: 149668 - DNA, 2566 bp, Homo sapiens
  Payload ID: 9563
  Gene Symbol: LRP10
  Gene Name: low density lipoprotein receptor-related protein 10
  ENST ID: ENST00000551466
  CDS Start-End: 1-1375
ggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctgtgagcaagagcctgaggaagtagcagagaggggtgtgggcccatgtgcagttctgggaccctggcaccttggctcagggaagacccgagctcctttcactgcagaccctctccagagactggggagagggctctggagaacctggttcttgcttactgttctccctttgggccctccttcccaaacgcaaacaatccaggatccactcagcgtcaggcccaatggaaatagtgaagcagtgattttccctcccctgcctctccatagcctggtcttttgccctctcctttgctcttctcttcccccatagccacctcaaatacctgcagcctgatatcttcatcccttcatccagaccttttctctcctagtggtattgcaaactgaaagtggacaaagacttaaggtaaacctgctcctcatggtggaatgcttccaaatgctggaaggaggactttagggcagagttcactaaggaggcttgtgcttatagatcagtgggcctgaaagaagtttctctaggttctggttgtgtgctgtacgaggtgtaggtagtaataatactcttgtcagccacagtgaagccccaagctagccgggataggggactgaccttgtacaggcagcatggagaaactaagacagagtgtcctgcccaagtgatggcactggggagcagtcactcaggtttatttccaccagggcccaagaaaaaaagaaatgaggcaacctaaaattccatcaagatagataccaatatccaaggtgcttggtcttagcggtgtgggacccacgttaaggctcttggtgggaaggtgggaggtgttttcagcatgagatagggttcaggctgtgaatcagagtctagagcctaagataaaagaagataccagggctgggccacggtggctttcgcctgtaatcctagcactttgggaggccaaggcaggcagactgcctgagctcaggagttcgagactagcctgagcaacacggtgaaaccctgtctctactaaaatacaaaaaagtagccaggtgtggcggcatgcacctgtagtcccagctactcgagaggctgaggcaggagaattgcttgaacccgggaggcggaggttgcagtgagtggagatcgcgccactgcactctagcctgggtgacagagcgagactccttctccaaaaaaaaagaaaagaa

SEQ ID NO: 149669 - DNA, 3260 bp, Homo sapiens
  Payload ID: 9564
  Gene Symbol: LRP11
  Gene Name: low density lipoprotein receptor-related protein 11
  Uniprot ID: Q86VZ4
  ENST ID: ENST00000239367
  CDS Start-End: 7-1509
gtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggcccgggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattatt

SEQ ID NO: 149670 - DNA, 1042 bp, Homo sapiens
  Payload ID: 9564
  Gene Symbol: LRP11
  Gene Name: low density lipoprotein receptor-related protein 11
  ENST ID: ENST00000367368
  CDS Start-End: 7-984
gtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggcccgggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggagatggatggtccatttgctgcatctgttccaagagggaagctaaggagtttagtgaaaccagttgaactcgtggaagcagagagtggaatggcggttactggaggctgtgcgggggacggactg

SEQ ID NO: 149671 - DNA, 4112 bp, Homo sapiens
  Payload ID: 9565
  Gene Symbol: LRP12
  Gene Name: low density lipoprotein receptor-related protein 12
  Uniprot ID: Q9Y561
  ENST ID: ENST00000276654
  CDS Start-End: 110-2689
ggtggctcggcggcggcggcggcggcggcggcggcgtcggcgtcgtctacctccagcttctcctccctcctcctccgtctcctcctctctctctccatctgctgtggttatggcctgtcgctggagcacaaaagagtctccgcggtggaggtctgcgttgctcttgcttttcctcgctggggtgtacggaaatggtgctcttgcagaacattctgaaaatgtgcatatttcaggagtgtcaactgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatattttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgttaatgctgtcaggaggaactgactaagatgttttaatatgtatcaaaaattaaaatgattttttttattgccttg

SEQ ID NO: 149672 - DNA, 4092 bp, Homo sapiens
  Payload ID: 9565
  Gene Symbol: LRP12
  Gene Name: low density lipoprotein receptor-related protein 12
  Uniprot ID: Q9Y561
  ENST ID: ENST00000424843
  CDS Start-End: 128-2650
agagcgcagggagcagccggtggctcggcggcggcggcggcggcggcggcggcgtcggcgtcgtctacctccagcttctcctccctcctcctccgtctcctcctctctctctccatctgctgtggttatggcctgtcgctggagcacaaaagagtctccgcggtggaggtctgcgttgctcttgcttttcctcgctggggtgtacgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatattttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgttaatgctgtcaggaggaactgactaagatgttttaatatgtatcaaaaattaaaatgattttttttattgccttgaggtactttttaaatcaaa

SEQ ID NO: 149673 - DNA, 889 bp, Homo sapiens
  Payload ID: 9565
  Gene Symbol: LRP12
  Gene Name: low density lipoprotein receptor-related protein 12
  ENST ID: ENST00000523007
  CDS Start-End: 288-889
aaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatc

SEQ ID NO: 149674 - DNA, 16535 bp, Homo sapiens
  Payload ID: 9566
  Gene Symbol: LRP1B
  Gene Name: low density lipoprotein receptor-related protein 1B
  Uniprot ID: Q9NZR2
  ENST ID: ENST00000389484
  CDS Start-End: 973-14772
aaagacagaaccccagagaaaaacgctgccaattcgttgctttattgttccctgcctggggacctcaatagccttttccattaaccttcccttcttacgcaacggttaatgactttgggggttgttttgctttctgtttctgctgagtcactaaattttgcctctttgtccccaggtgctgctcagcataaaagttaaaagtgcaattcaggaagtactgggattctgtgtagagccgaggaaaccatttccctaagagaagctctgttccttggcttgtccttccttcccgggaaggaagcttccgaggaacgaagggagaagctttgttttgcctgcagaagcagccctgtgctcggctgagggttctcagctggctgtgaactgcggagcattgtaggcgcctggctggctcaggccaatgcagaagtctctcccttctccaaagacccaaatccccacagaaccagcttcgagttactttcccttcaaggggattaaaataattgtgatttgtggcgctctccgttcgcggtggtattttcctgttgtgttaaatgcctcttattaagtaatagatgtgatttatgtgaacgacgaaggggtgtgtggtggattcggtgattaatcagtgaattcccatccgctggcatctctcactgcccctcttgcgtgatgtaagatcagacgtaccctgcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggcccctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggaactgttatccaattgccaacagctgaattgtcagtataaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagttagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcagggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcaaaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggatatcgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgcgacaataaggatgactgtggcgatggttcagatgagagaaactgccatataaatgaatgtttgagtaagaaagtcagtggatgttctcaagactgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaaggccaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcatattatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataatatataagcacacaaattggtgacagaatttcaattacgtgaacgcatcctctttgctaggtcaaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgttaaatatgtggttgctctttatccctttgtacaagcattaaaaaaactgctgttttataagaagactttttgttgtactatgtgcatgcatactacctatttctaaactttgccatattgaggcctttataaactattgatttatgtaatactagtgcaattttgcttgaacaatgttatgcatatcataaactttttcaggttcttgtttaagtacattttttaaattgaacagtatttttcattttggttataatatagtcattttgcctatgtttctacaatgaagtgttaaatactttataaaaaattgttgactgacttatttaaatgaaattctacatatttaa

SEQ ID NO: 149675 - DNA, 839 bp, Homo sapiens
  Payload ID: 9566
  Gene Symbol: LRP1B
  Gene Name: low density lipoprotein receptor-related protein 1B
  ENST ID: ENST00000442974
  CDS Start-End: 1-839
ggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctctgtggggtttaaaagtcagcgctgtgaccagaaagagaacccttgtgatcactactgtcagaatgaggggatttgcactttaactgcgtttaatgagccgagatgcaaatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtctttta

SEQ ID NO: 149676 - DNA, 2621 bp, Homo sapiens
  Payload ID: 9566
  Gene Symbol: LRP1B
  Gene Name: low density lipoprotein receptor-related protein 1B
  ENST ID: ENST00000434794
  CDS Start-End: 277-2621
gcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggcccctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacgg

SEQ ID NO: 149677 - DNA, 3810 bp, Homo sapiens
  Payload ID: 9566
  Gene Symbol: LRP1B
  Gene Name: low density lipoprotein receptor-related protein 1B
  ENST ID: ENST00000437977
  CDS Start-End: 1-2396
gtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaagccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcatattatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataatatataagcacacaaattggtgacagaatttcaattacgtgaacgcatcctctttgctaggtcaaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgtt

SEQ ID NO: 149678 - DNA, 13219 bp, Homo sapiens
  Payload ID: 9566
  Gene Symbol: LRP1B
  Gene Name: low density lipoprotein receptor-related protein 1B
  ENST ID: ENST00000618808
  CDS Start-End: 1-13218
gaactgttatccaattgccaacagctgaattgtcagtataaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagttagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcagggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcaaaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggatatcgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgcgacaataaggatgactgtggcgatggttcagatgagagaaactgccatataaatgaatgtttgagtaagaaagtcagtggatgttctcaagactgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaagg

SEQ ID NO: 149679 - DNA, 15808 bp, Homo sapiens
  Payload ID: 9567
  Gene Symbol: LRP2
  Gene Name: low density lipoprotein receptor-related protein 2
  Uniprot ID: P98164
  ENST ID: ENST00000263816
  CDS Start-End: 287-14254
aaagtgcagggggcgggccgggcggcagggggcctgcccgctggattcccgcatgcttgttccggggcggtcgggtctaaagggctttatgcactgtctggagggtggggactggcgcgggtagaaaacgggatgcctcgggcgtgggggcaggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgtgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcgaatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacgtgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcagctgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattagaatgtactgtacagtccagatcttttctttaattcttattggttttttttttttttttttttttagagatggagtcttgctatattgccaaggctgatcttgaagtcctgggctcaagtgatcctcccacctcagcctcctgagtggttggggttacgggcgtgagccactgtgcctggcttccagctctcctcttaaatagtgggtatagtctgcacaacaggaaccatggcaggaatatacactttcccatagcaaatagcatacctgactctctgtgctaatattgcacatttgttaaacaatgaatgaatggatggatggatggatggatgaatgaatgaaacatatactactgattattttattccagagttctcaaaatatttgttgctgatattttgagtgctgactgtaattactttgattagataaacaactggaaataatgctgctgaaaaagttctaataaatgtgtattttatcaga

SEQ ID NO: 149680 - DNA, 4007 bp, Homo sapiens
  Payload ID: 9567
  Gene Symbol: LRP2
  Gene Name: low density lipoprotein receptor-related protein 2
  ENST ID: ENST00000443831
  CDS Start-End: 136-3813
aggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccaactcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgacgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttgggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgtcctcagccacagaacagataatgatggtttgggtttccgttgcaagtgcacattcggcttccaactggatacagatgagcgccactgcattggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacagagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcaggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctgaacagtagcctggtgtgcatcaccattgtcacagtcactgtgtagctttgtaggaaggatttcagttcctctatgagttcacatctgtgtagggggtaaccataattgaattcaaatacatcaccattggataattttctgattaaatcctttgtacttggttatgtgtttttacttctttttatgtctttgttt

SEQ ID NO: 149681 - DNA, 3807 bp, Homo sapiens
  Payload ID: 9568
  Gene Symbol: LRP3
  Gene Name: low density lipoprotein receptor-related protein 3
  Uniprot ID: O75074
  ENST ID: ENST00000253193
  CDS Start-End: 203-2515
tacgggcctgcaccgccaccgcacaaagacgcctcgggagccgccgcctgcacccgggccgcagcagccacgccagccggagcccgagccctagcccgagcccgagcccgagccgcagccagagccagagccggagccgcagccggaaccggagccggagccgcggggcaggaggcggcgcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcactgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggtagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggcgggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcctcgacatccctttagggcagggggactctgggtgccatggtagggagcgcctgtgtcaagcagcaaagccccctaatgtcaagagcctcctccagggcctgccacggcatcttcctggccagcaacatgtgtgcacccaccgaggtacgccccagccactcccatctgtgcccatcagggactccccatagcacgagcgaacagccagccctgtttatttataggccttttcaggaagagctagcagggcagtgctaagacaggaaacccagtccacattttagggcttccttaaacaggcttctgagagtcgtatcttttttcttttttttccagaaaaaaacaaaacaaaacttttttgccaaaacacctcctcaataaacaacatgtaaacagaaacaa

SEQ ID NO: 149682 - DNA, 575 bp, Homo sapiens
  Payload ID: 9568
  Gene Symbol: LRP3
  Gene Name: low density lipoprotein receptor-related protein 3
  ENST ID: ENST00000592484
  CDS Start-End: 301-575
gcaaaggcctgaagattgcccgtctccctgcagccgcgcagtgggtgcagccttttcacaaatgcaagacctggaccggcggcgaggccaaggggaccccgtgtggagggatgcgggactgagtccgtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtga

SEQ ID NO: 149683 - DNA, 8076 bp, Homo sapiens
  Payload ID: 9569
  Gene Symbol: LRP4
  Gene Name: low density lipoprotein receptor-related protein 4
  Uniprot ID: O75096
  ENST ID: ENST00000378623
  CDS Start-End: 244-5961
gtggccggggctgcggcgcggggggcggggcggtcgggcccgggacaccccctcccggtcccctggcggggcagcgtcggctctggcagcactggaggcggcggcggcccgagggcgacttgcggggcgcgcaggccgccgtgcacccgggacgcttccccctcggggaccctccgcgggcttctccgccgcgccgtccggcgggagccggcgggaccccgggcgagcggcgcgggcggcaccatgaggcggcagtggggcgcgctgctgcttggcgccctgctctgcgcacacggcctggccagcagccccgagtgtgcttgtggtcggagccacttcacatgtgcagtgagtgctcttggagagtgtacctgcatccctgcccagtggcagtgtgatggagacaatgactgcggggaccacagcgatgaggatggatgtatactacctacctgttcccctcttgactttcactgtgacaatggcaagtgcatccgccgctcctgggtgtgtgacggggacaacgactgtgaggatgactcggatgagcaggactgtcccccccgggagtgtgaggaggacgagtttccctgccagaatggctactgcatccggagtctgtggcactgcgatggtgacaatgactgtggcgacaacagcgatgagcagtgtgacatgcgcaagtgctccgacaaggagttccgctgtagtgacggaagctgcattgctgagcattggtactgcgacggtgacaccgactgcaaagatggctccgatgaggagaactgtccctcagcagtgccagcgcccccctgcaacctggaggagttccagtgtgcctatggacgctgcatcctcgacatctaccactgcgatggcgacgatgactgtggagactggtcagacgagtctgactgctcctcccaccagccctgccgctctggggagttcatgtgtgacagtggcctgtgcatcaatgcaggctggcgctgcgatggtgacgcggactgtgatgaccagtctgatgagcgcaactgcaccacctccatgtgtacggcagaacagttccgctgtcactcaggccgctgtgtccgcctgtcctggcgctgtgatggggaggacgactgtgcagacaacagcgatgaagagaactgtgagaatacaggaagcccccaatgtgccttggaccagttcctgtgttggaatgggcgctgcattgggcagaggaagctgtgcaacggggtcaacgactgtggtgacaacagcgacgaaagcccacagcagaattgccggccccggacgggtgaggagaactgcaatgttaacaacggtggctgtgcccagaagtgccagatggtgcggggggcagtgcagtgtacctgccacacaggctaccggctcacagaggatgggcacacgtgccaagatgtgaatgaatgtgccgaggaggggtattgcagccagggctgcaccaacagcgaaggggctttccaatgctggtgtgaaacaggctatgaactacggcccgaccggcgcagctgcaaggctctggggccagagcctgtgctgctgttcgccaatcgcatcgacatccggcaggtgctgccacaccgctctgagtacacactgctgcttaacaacctggagaatgccattgcccttgatttccaccaccgccgcgagcttgtcttctggtcagatgtcaccctggaccggatcctccgtgccaacctcaacggcagcaacgtggaggaggttgtgtctactgggctggagagcccagggggcctggctgtggattgggtccatgacaaactctactggaccgactcaggcacctcgaggattgaggtggccaatctggatggggcccaccggaaagtgttgctgtggcagaacctggagaagccccgggccattgccttgcatcccatggagggtaccatttactggacagactggggcaacaccccccgtattgaggcctccagcatggatggctctggacgccgcatcattgccgatacccatctcttctggcccaatggcctcaccatcgactatgccgggcgccgtatgtactgggtggatgctaagcaccatgtcatcgagagggccaatctggatgggagtcaccgtaaggctgtcattagccagggcctcccgcatcccttcgccatcacagtgtttgaagacagcctgtactggacagactggcacaccaagagcatcaatagcgctaacaaatttacggggaagaaccaggaaatcattcgcaacaaactccacttccctatggacatccacaccttgcacccccagcgccaacctgcagggaaaaaccgctgtggggacaacaacggaggctgcacgcacctgtgtctgcccagtggccagaactacacctgtgcctgccccactggcttccgcaagatcagcagccacgcctgtgcccagagtcttgacaagttcctgctttttgcccgaaggatggacatccgtcgaatcagctttgacacagaggacctgtctgatgatgtcatcccactggctgacgtgcgcagtgctgtggcccttgactgggactcccgggatgaccacgtgtactggacagatgtcagcactgataccatcagcagggccaagtgggatggaacaggacaggaggtggtagtggataccagtttggagagcccagctggcctggccattgattgggtcaccaacaaactgtactggacagatgcaggtacagaccggattgaagtagccaacacagatggcagcatgagaacagtactcatctgggagaaccttgatcgtcctcgggacatcgtggtggaacccatgggcgggtacatgtattggactgactggggtgcgagccccaagattgaacgagctggcatggatgcctcaggccgccaagtcattatctcttctaatctgacctggcctaatgggttagctattgattatgggtcccagcgtctatactgggctgacgccggcatgaagacaattgaatttgctggactggatggcagtaagaggaaggtgctgattggaagccagctcccccacccatttgggctgaccctctatggagagcgcatctattggactgactggcagaccaagagcatacagagcgctgaccggctgacagggctggaccgggagactctgcaggagaacctggaaaacctaatggacatccatgtcttccaccgccgccggcccccagtgtctacaccatgtgctatggagaatggcggctgtagccacctgtgtcttaggtccccaaatccaagcggattcagctgtacctgccccacaggcatcaacctgctgtctgatggcaagacctgctcaccaggcatgaacagtttcctcatcttcgccaggaggatagacattcgcatggtctccctggacatcccttattttgctgatgtggtggtaccaatcaacattaccatgaagaacaccattgccattggagtagacccccaggaaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgcggtgctcatcaacaacaacctaggatggcccaatggactgactgtggacaaggccagctcccaactgctatgggccgatgcccacaccgagcgaattgaggctgctgacctgaatggtgccaatcggcatacattggtgtcaccggtgcagcacccatatggcctcaccctgctcgactcctatatctactggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcagccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccggccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagacggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttagtaacatgaaaaagctttggggggtagttggatctgggtgtctggtccattgctggcagtggacattattcttgccctaagagacactgccttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcacgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatc

SEQ ID NO: 149684 - DNA, 663 bp, Homo sapiens
  Payload ID: 9569
  Gene Symbol: LRP4
  Gene Name: low density lipoprotein receptor-related protein 4
  ENST ID: ENST00000534404
  CDS Start-End: 264-663
cgggcccaggcgcggtggcggtggccggggctgcggcgcggggggcggggcggtcgggcccgggacaccccctcccggtcccctggcggggcagcgtcggctctggcagcactggaggcggcggcggcccgagggcgacttgcggggcgcgcaggccgccgtgcacccgggacgcttccccctcggggaccctccgcgggcttctccgccgcgccgtccggcgggagccggcgggaccccgggcgagcggcgcgggcggcaccatgaggcggcagtggggcgcgctgctgcttggcgccctgctctgcgcacacgtactacctacctgttcccctcttgactttcactgtgacaatggcaagtgcatccgccgctcctgggtgtgtgacggggacaacgactgtgaggatgactcggatgagcaggactgtcccccccgggagtgtgaggaggacgagtttccctgccagaatggctactgcatccggagtctgtggcactgcgatggtgacaatgactgtggcgacaacagcgatgagcagtgtgacatgcgcaagtgctccgacaaggagttccgctgtagtgacggaagctgcattgctgagcattggtactgcgacggtgacaccgactgcaaagatggctccgatgaggagaactgtc

SEQ ID NO: 149685 - DNA, 5159 bp, Homo sapiens
  Payload ID: 9570
  Gene Symbol: LRP5
  Gene Name: low density lipoprotein receptor-related protein 5
  Uniprot ID: O75197
  ENST ID: ENST00000294304
  CDS Start-End: 107-4954
gcccgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatgggcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgatcaatgttgatgggacgaagaggcggaccctcctggaggacaagctcccgcacatttttgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaa

SEQ ID NO: 149686 - DNA, 586 bp, Homo sapiens
  Payload ID: 9570
  Gene Symbol: LRP5
  Gene Name: low density lipoprotein receptor-related protein 5
  ENST ID: ENST00000529702
  CDS Start-End: 1-518
cgtccagcagctcgtccagcacgaaggccacgctgtacccgccggggctcggatctggctgtatgctttccaggatggccttggagacccacataagccctacaccctttgggaagctgcatgttgggttggggtgccgtcagtggcacttgtggaagatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaa

SEQ ID NO: 149687 - DNA, 5103 bp, Homo sapiens
  Payload ID: 9570
  Gene Symbol: LRP5
  Gene Name: low density lipoprotein receptor-related protein 5
  ENST ID: ENST00000529993
  CDS Start-End: 32-1447
gcggcgcgggcccgtccggccgccggacaacatggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtgatcaatgttgatgggacgaagaggcggaccctcctggaggacaagctcccgcacatttttgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaagggctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagcccgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctcagcccacccatgtgcccgtgacaatggtggctgctcccacatctgtattgccaagggtgatgggacaccacggtgctcatgcccagtccacctcgtgctcctgcagaacctgctgacctgtggagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgccatctgcctgcccaaccagttccggtgtgcgagcggccagtgtgtcctcatcaaacagcagtgcgactccttccccgactgtatcgacggctccgacgagctcatgtgtgaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccgatcctgaacccgccgccctccccggccacggacccctccctgtacaacatggacatgttctactcttcaaacattccggccactgcgagaccgtacaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaaca

SEQ ID NO: 149688 - DNA, 1661 bp, Homo sapiens
  Payload ID: 9571
  Gene Symbol: LRP5L
  Gene Name: low density lipoprotein receptor-related protein 5-like
  Uniprot ID: A4QPB2
  ENST ID: ENST00000402859
  CDS Start-End: 525-1283
tacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagacaagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttcaaaaaaaatagacgattataatgagcaaatccggtagacac

SEQ ID NO: 149689 - DNA, 1193 bp, Homo sapiens
  Payload ID: 9571
  Gene Symbol: LRP5L
  Gene Name: low density lipoprotein receptor-related protein 5-like
  Uniprot ID: A4QPB2
  ENST ID: ENST00000402785
  CDS Start-End: 98-856
ggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagacaagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttc

SEQ ID NO: 149690 - DNA, 1714 bp, Homo sapiens
  Payload ID: 9571
  Gene Symbol: LRP5L
  Gene Name: low density lipoprotein receptor-related protein 5-like
  Uniprot ID: A4QPB2
  ENST ID: ENST00000444995
  CDS Start-End: 702-1376
agacgaagatgcagggacacgcgcgaggagccgccgcagccgccgccgccgcgctgtggagcccgagtgagcgcggcgccagcccgtccggccgctggacaacatggaggctgcactgcccgggccgccgtggccgctgctgctggcgctgtgcggctgcccggcccccgccgcaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagacaagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcgggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttcaaaaa

SEQ ID NO: 149691 - DNA, 600 bp, Homo sapiens
  Payload ID: 9571
  Gene Symbol: LRP5L
  Gene Name: low density lipoprotein receptor-related protein 5-like
  ENST ID: ENST00000468442
  CDS Start-End: 590-600
tggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctagagggggtttttgagactagaatcacctcagcatcctcctgtccccagctgtgtccagcctgtctgcagggacatcctgagaggactaggctctcccctcatccacctgcgagccaaggaggtcctgctgctggcccggtagacggaccaatggagggtctcgctggacacaccggacttcaccgacatcgtgctgcagctggacgacatccagcatgccatcgccatcaactatgacccaatggagggcca

SEQ ID NO: 149692 - DNA, 814 bp, Homo sapiens
  Payload ID: 9571
  Gene Symbol: LRP5L
  Gene Name: low density lipoprotein receptor-related protein 5-like
  ENST ID: ENST00000474163
  CDS Start-End: 134-346
aggagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgagcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagacaagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaag

SEQ ID NO: 149693 - DNA, 3602 bp, Homo sapiens
  Payload ID: 9571
  Gene Symbol: LRP5L
  Gene Name: low density lipoprotein receptor-related protein 5-like
  Uniprot ID: A4QPB2
  ENST ID: ENST00000610821
  CDS Start-End: 2466-3224
gcctagagggagaaaacttgttgaaattcagagatccccctccccctaccaatacacaccaaatcagacgcctctgaccagatctgaatttggctctcagagatttccattgtagccaggcagttggggcactttctgagtgctgcctccacctcactgtccccagcctgcctgcctccgtttccctagccctgggcctgtgccgctgtcaccatcacctgggcgccctctagtggatgaatcggattatgcacgagggggcttggagcaggattcagaaggggctcctgtccttccttgaaatgctggacgccgggatcctggaacagctcttcaggtctctgcattcctcctggcaacagccagagcctgggcgcagggggctactgttgtttgaaggctgaaggctgcagcctggtagggcactcaggagacctggcagttggctgcagggccaggtctaggggccagggcatgagggatgctctgggctggctcagccccgggcccccatgcggattgtgactgtgggggcatggccacatgatgttgaggggggatctctgaccctgaccttcttggctctgtgcatccttgaaaccagaaaggtctggaacaaatcagtgaacaatgccctaactcggggagggagccacatcctgaccccagcagcctcagaaggatccgtgtcagggttatggggcaccctgggggccccgagtctgcatgggtctccacatgcaacttctgccggaaactctgaaaaatcccaactggggggtcataggacacaatcagaaatgctgatgccactgtgtgtggatccccgggccctggggggtcaggagcatgtagaaggtgggccacagggggttcataagagaatcctgtaaccgcccctgccccccaaacttagaagcccactggagggccatgggtgaaagcttgggggggtgtcctgtggagtgggtggtggggggtctttgggtttacatgctgctgggcctgagcagcaggaccccgtccacagctgatccctgggccctgctgctcagctgctctcttgagtgttgctgtggctgccgagagagcctgagtcgagcctctcttgtgccggccgtacgctgtcaggccacgctggtgagtttggcaaggcacagatgcccagagcagagaactttccttggggatttaatatgtgcgaatcttgaggtccggcaaatctttccctcagctagagagggggtttttgagactagaatcacctcagcatcctcctgtccccagctgtgtccagcctgtctgcagggacatcctgagaggactaggctctcccctcatccacctgcgtaagtgccaccctgaagcctgtccacccatgcttggagaggcttggcctcaacctgcttagccagcagcaggcttgggcctggggtgcagcagagacccaggtggctgtggggtggttgcttcatggggtggttctgaaacgcagttggaagtgcatggacagtgccttacctgttctctgtgggaccctgtttagaaaccaggtctgagttactgggggtcatcgctacattctgatggcctagctgtgtggaggccacggtggagccccatccaaggagccagggccctgggtctagccgtgaccagaacgcatgccctggaggtgtttctcatcttgcacctgtgttgcctggtgtctcaagtggccacaaaactgtgttagctcttggtgcccctgggcttcggaaccagggtttcccttcatctcagtgacccgggagcatctgggcagtgagtaaagagggtgatttacttgatgggtacgtttggtcctgcctgggagcccccccaggcacggtcctgggacctgaagctgccctcgttggtggaggggagggagagagcttcagggatgaggtggcgttgagctgggcgggaagggtgagcccctgcaaggtggggtgggtgtgctggggacgctgagcagcacggccagcaggtgggtcttcagctcggtacccggtgggacttgtggttggggctggtgtgtggccaggagaggggctggcagaagacaagggggactgtgaggcagctcccatccagcggttgaagcctgatggcctggctctgtgcctcagttctctcatctataaaatgagaaaacagtgccagcctcccagacctgtcatgaggatgaacgagtgaccacgtagcatgggctgggtgcgtgtcacctaacattaccagcctttgcaaggagagccctggggacctggctgagtttttcccttgcctggcccactgcacctgtccccacaggagccaaggaggtcctgctgctggcccggtagacggaccaatggagggtctcgctggacacaccggacttcaccgacatcgtgctgcagctggacgacatccagcatgccatcgccatcaactatgacccaatggagggccacgtctactggacggatgacgaggtgtgggccatccgcagggcatacctggatgggtctggggcgcagacgctgatcaacaccaagatcaacgaccccgatgacatcgcagtcaactgggtggcccgaagcctctattggacccacacaggcactgaacacatcgaggtgacgtgcctcaacagcacctcccacaagatcctggtgtcagaggacatggacgagccccgtgccattgcactgcatcccgagatgggcctcacgtactggatagactggggagagaaccctgaaatcaagcgtgccaacctggacaggcaggagctgcgcgtgctggtcaatgcttccctcgggtggcccaacggcctggccctggacctgcaggaagggaagctctactggggagatgccaagacagacaagatcgaggcgatcagtgtcgatgagacgaagaggcagaccctcctgaaggacaagctcccacacattttcaggttcaccctgctgggggacttcatctactggaccgcctggcagcaccacagcatcaagcgggtacacaaggtcaaggccaaccgggacgtcatcattgaccagctgcccgacctgatggggctcaaagctgtgaacgtggacaaggtcgtcggaaccaaccctcatgcggacaggaatgggggtgcagccacctgtgcttcttcacgccccacacaacccggtttggctgccccatctagggcctggaactgctgagtgacatgaagacctgcatcatgcccaaggccttcttggtcttcaccagtagagccgccatccacaggatctccctcgagaccaacaacaacgatgtggccatcctgctctcggcgtcaaggaggcctcggccctggactttgatgtgtccagcaaccacatctactggacagacatcagcctgaaggtagcgtgggcccgaacatgcacacgtgcagcctatatgggaaaaccttccctctgtacctgcctcaaaggtttcagacatttttcttaaagcactataatatttattgtaacacaattcaagctaattaaatatgagcaagcctatttcaaaaaaaatagacgattataatgagcaaatccggtagacac

SEQ ID NO: 149694 - DNA, 10020 bp, Homo sapiens
  Payload ID: 9572
  Gene Symbol: LRP6
  Gene Name: low density lipoprotein receptor-related protein 6
  Uniprot ID: O75581
  ENST ID: ENST00000261349
  CDS Start-End: 78-4919
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccgttgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcaattttgaaccctccaccatccccagccacagagcgatcacattacactatggaatttggatattcttcaaacagtccttccactcataggtcatacagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtaaatataaatttggttgagatctggagggggggagggagctattagagaaggatgaggcagaccatgtacagttaaaattataaaatggggtagggaatactggagatatttgtacagaagaaaaggatatttatatattttcttaaaacagcagatttgctgcttgtgccataaaagtttgtataaaaaaaatttgtactaaaagttttatttttgcaaactaaatacacaaagcatgccttaaacccagtgaagcaactgagtacaaaggaaacaggaataataaaggcatcactgaccaggaatatctgggctttattgataccaaaaataaaaaagaggaagaagaaaaattaagtccatctcagagcagcaaaccatagatacatggatgtagccagatagccttcagttaactaacatttgagggccaacaagtaagaaatgatgaaaggaaaaaaatgcaattaatactaaccttggacgaagggctttgttttctctaggaatccaacagtgctagtgaggaaagtagatatttctaaaaacccattctgggtgttgctgttgtaggagagatcagccctctggtaagatgccatgaagctgtgtgtgtgtgcaagtctctgtccctacctttagaatccatacctctgtcaaaatgaatttttttctctaggtatgtttaccttgctgcctcctccagcaacttggtaagtcattttgctaagataccatgatttttttaagctgaagcattgactaaatggaattttctaaattaaacttgattttaatatttcttctagctccattccccagtaggcttagctcttcaatttgactgctgtttttgcataatgatcaaaagttagacatattatttctcttcttccaagattgttttaatgctcattaaaatgtctttttacaacacatatagacaatgtttaagaattaaaaatttaaccattatgtttttgttgtaaatctcatatccttgcactactttcagcatatatcacagtacgaaatcatttatatatatatatatatatatatatatatatatatatatatatatatatatattttgtttgtttgtttgttttctgagtaaaacatttaaatatgttctggttagagacaatctatttaaaaagatttttttcttattaggattttccctatattaacagtttgtgatgttttcatgttctttagaccggtttttctcagaataatgtctacatacatacctcttctaatgtgtgacatgaatttaatatctttctgttacccactgtgaatgttaggctgttttcaaattatccacaaattattcttgtaatcacccaatatttttatgtgggtcctctcttacccattatggattaagatagtttaacaaatttaacaatgaggattaaatgagaaggcaaactgttaacttctcagctgtcagaatttgggtggaagggaataatggaagcctcttttgtgatctgcctgacctgctgtcatgtatggtactggggctgctacatcttgagctatcagggctgacctgtggaatgattctagcacttgctctgccaccttgccagaagttcgtttcctgctttttacacatgtgtagcacttctctgctaaaattgaatggttttaaactaatgtatttttagcttaagaggtgttggtcagttaattattgaattttttttttttcttttttaattctgtcttgccaaggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagaatcctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattaaaaatagccatcatctgtattaggtagcagttttggaggatcatctttttcttttgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaa

SEQ ID NO: 149695 - DNA, 562 bp, Homo sapiens
  Payload ID: 9572
  Gene Symbol: LRP6
  Gene Name: low density lipoprotein receptor-related protein 6
  ENST ID: ENST00000535731
  CDS Start-End: 337-562
gaatgaggagctgcgcgggggaagcggggcgccgggggaggaggcggcgggatggaagcagacgctggcgtcgcgcgagcccggggccgagcggcgcggtagagagggcggcggcggcgcgcgcggaaccttgacgtgcccctttctttcttctctcgctgggaagctgggaagtatgagcgtgcagccctgccgctgcggcggccgccccggctcctcgcctcccccacttctggccacccctcgccggtgagagaagagaacgcgagaagggaagatgggggccgtcctgaggagcctcctggcctgcagcttctgtgtgctcctgagaggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatc

SEQ ID NO: 149696 - DNA, 4774 bp, Homo sapiens
  Payload ID: 9572
  Gene Symbol: LRP6
  Gene Name: low density lipoprotein receptor-related protein 6
  ENST ID: ENST00000543091
  CDS Start-End: 35-4741
tcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccgttgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcaattttgaaccctccaccatccccagccacagagcgatcacattacactatggaatttggatattcttcaaacagtccttccactcataggtcatacagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacg

SEQ ID NO: 149697 - DNA, 593 bp, Homo sapiens
  Payload ID: 9572
  Gene Symbol: LRP6
  Gene Name: low density lipoprotein receptor-related protein 6
  ENST ID: ENST00000540527
  CDS Start-End: 1-210
aactgtgaagtgctttgtttaattgatcagttccgctgtgccaatggtcagtgcattggaaagcacaagaagtgtgatcataatgtggattgcagtgacaagtcagatgaactggattgttattttgaaccctccaccatccccagccacagagcgatcacattacactatggaatttggatattcttcaaacagtccttccactcataggtcatacagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtaaatataaatttggttgagatctggagggggggaggg

SEQ ID NO: 149698 - DNA, 7812 bp, Homo sapiens
  Payload ID: 9572
  Gene Symbol: LRP6
  Gene Name: low density lipoprotein receptor-related protein 6
  ENST ID: ENST00000538239
  CDS Start-End: 1-4436
agttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccgttgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcaattttgaaccctccaccatccccagccacagagcgatcacattacactatggaatttggatattcttcaaacagtccttccactcataggtcatacagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtatgtttaccttgctgcctcctccagcaacttggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagaatcctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattaaaaatagccatcatctgtattaggtagcagttttggaggatcatctttttcttttgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagt

SEQ ID NO: 149699 - DNA, 10020 bp, Homo sapiens; identical to SEQ ID NO: 149694
  Payload ID: 9572
  Gene Symbol: LRP6
  Gene Name: low density lipoprotein receptor-related protein 6
  Uniprot ID: O75581
  ENST ID: ENST00000628182
  CDS Start-End: 78-4919

SEQ ID NO: 149700 - DNA, 562 bp, Homo sapiens; identical to SEQ ID NO: 149695
  Payload ID: 9572
  Gene Symbol: LRP6
  Gene Name: low density lipoprotein receptor-related protein 6
  ENST ID: ENST00000626182
  CDS Start-End: 337-562

SEQ ID NO: 149701 - DNA, 4774 bp, Homo sapiens; identical to SEQ ID NO: 149696
  Payload ID: 9572
  Gene Symbol: LRP6
  Gene Name: low density lipoprotein receptor-related protein 6
  ENST ID: ENST00000626698
  CDS Start-End: 35-4741

SEQ ID NO: 149702 - DNA, 593 bp, Homo sapiens; identical to SEQ ID NO: 149697
  Payload ID: 9572
  Gene Symbol: LRP6
  Gene Name: low density lipoprotein receptor-related protein 6
  ENST ID: ENST00000626957
  CDS Start-End: 1-210

SEQ ID NO: 149703 - DNA, 7812 bp, Homo sapiens; identical to SEQ ID NO: 149698
  Payload ID: 9572
  Gene Symbol: LRP6
  Gene Name: low density lipoprotein receptor-related protein 6
  ENST ID: ENST00000625211
  CDS Start-End: 1-4436

SEQ ID NO: 149704 - DNA, 7648 bp, Homo sapiens
  Payload ID: 9573
  Gene Symbol: LRP8
  Gene Name: low density lipoprotein receptor-related protein 8, apolipoprotein e receptor
  Uniprot ID: Q14114
  ENST ID: ENST00000306052
  CDS Start-End: 103-2994
gcagcggcaaccccggcgccgcggcaaggactcggagggctgagacgcggcggcggcggcgcggggagcgcggggcgcggcggccggagccccgggcccgccatgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgacgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgtccgggccccggggccacgtccgcgcccgccgcctgcgccaccgcctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaaacacttcaactccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtaccagagtgctcagaaactcaagataggatatgcctcaccctcagctactccttgttttaaagttcagctctttgagtaacttcttcaatttctttcaggacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaacattttaaggtaataaataggttacttaccatcatatgttcatatagatgaaactaatttttggcttaagtcagaacaactggccaaaattgaagtcatatttgaggggggaaatggcatacgcaatattatattatattggatatttatgttcacacaggaatttggtttactgctttgtaaataaaaggaaaaactccgggtatatgtatagatgttcttcattatagacatcttctttgcttttcttggccttgggggaggaagggagaagtgctcttttctacttgtggggtctcccattggaaacataatcctatagtcccagaaggattcagtccccagtggctttcccatccaaagagaaagagtttgagtttcttaactctgctgttctgccacttactcccactagacaaccagggacaaggtgcaacatggaagtgtttgacttaagtaggagcagaggagctgcatctaatctcatcatacctggaacttgacacacttaagcaaatgccttcccatccctacctgccagatgcccccaactcaatgaagttggatgtctcaccagcttgataccctttgaattttcagtcagacattctggagttctagcatcctgtacctaggaccttcctctgtgtcactcttggcctcctaaactctaagaaaataactatattctggagcttgggcagtgtgttttgcataatccagcaatctcctcatgacatgcatgtgttgatagtcctgaaacattcattgagagggtaaatgcagttgacctagaatgaccaataccaaacagaattttaagaacaggtggccaactcctatggagcttactcacatattactattcttttaagaacggaaagtaaaattatttttgactgaagaaaaatgatgacagtgaaaaacatggaaatgtactcaaaacaagtgactttttctgtaaccttccaaagaaactgaattttccaaggaattaaatgataacagtggctaaggcatagtttctaaactttcagtaagatcctggcattcacagaaaaaaatgatgaatggggtctggacatacagcctgagatctcaaaatgacaatgaaattcacaactttttctcagagacattcatgtttcctgcatatgctacaactgcagtttgaaagaggcagcaatgggagcaaccctttacaagaaacaaattgtgatatattcatgtgttggacggcagtaaataagatgaaacctgaggagtcagatccaccttcccccattcatagaggcttttcagcctcattttgaggtacagttacatatcttttgccttttgcccccgtgcatagctatctacagccaatcacagatcacagagtcactggactatagagctggaaggaagctcagagacaatgccaagggggcagaaaatttatcagaagccagtcccagtgcgtttcctccatttccttctgcaggaagactattttgggctgcctgaacattgtatcaaacctgctacctatactatggtctacctttcctccagtggaattacaaaggcactaactgaaatgccttctagaaacagagaaaacgaaactgtacttatttactcttgatacacagattatttataaaacagattgaagtaacctgttaactggcaaaaagagaatgagatcggatttaaatgtatggcagtaagtcctattgatccctccagttatctcagtatgactgcagtatattcattcactaaaaccactcactagataccaactacacacctggcactgcagatgtaaaggtcagtcacacatgttctgactttacagagttcacagtagcagtggaggatgatatatgtggaaacaaaaaaggcattgattctattcagagcactgttagggctcaaaggagagaggggtctttccacctaagaaatgaggaatagggtcatcatagaagtgaccttaagtcttaaaaattaagaaggggattccaagctgcttcagacagagacacatcgagctaaaacacagaggtatgaaagagcacagggactttaggaattgcacagttcattctaacaggaacaaaaggctcaaggggggcaagaaatgaggctgtatggaaagagattcaatgtaagcactttataaaatagattaatttctgattcaatgaagcatttcttgatcattgtgtacaaggcactacatgcatcatggaaaattcattaggatgcattgccagcactttgcagaactgatattattcagcctcaagctttccagtggccaaagggaaatgctgactgcttttcatatatttgagtcaaagattttttatatggtcaatgaagactaatataagggcagtgggattttcacagatgcatgccatgttgtcgagagcctcttagattttctcaactgtgagaaagaaaaacgaaaatgttgaagacgttgagtctggagaggggatactaatcactgtccagttgggcactggtgggaatggggaaatggcacaggaatgcaagcctctccaccctaccccccgaactccagccatacactcatcgtttcacaaaatataaatgagttagcattaaatgtttcagagtaaataattccttttcccgaaatgcatgaagatagagtaacagacttctcacactgtatttttagggtatggagaatttagaaggttaaagaattactgcttcaatttttcagttaaaaaaaaatcaggaagctctgttcattcaggctatgcaccatgtgcacagtcaagaattagcagaaaccctctgcatttacaaacactttgtgctataaaaaagtaatttttaaaaagccacgtgtgtgtgtgtgtatatatatatatatatatatatttaaagccaaggttttgatacttttttacaaaaactacaagagaaaacaaatatacctgtccaaaccatatacttttaaaagagcatttttttttccatacaagctgttgttaatttgggggtaaagtgctgatttgcaaacttcatcaaattgttcccaagtggattctccttgtttgtctccccctaccaaccccaaagttaccatatttgatgtaagaatcaggcatgttagaatgttgtgtcacactaactgattctgctctttttgtcttgtcattcaagttccgttagcttctgtacgcggtgccctttgcagtctggtgtctcttccagaggcgagggggctgaggatggggtgctgcatctcactagctatactggcatcatcttggtaaactgaaaaccaaatgtggacatttgtaaaatcagtgcactgtttctagagagagattaaattcatttaaaaaaaa

SEQ ID NO: 149705 - DNA, 2382 bp, Homo sapiens
  Payload ID: 9573
  Gene Symbol: LRP8
  Gene Name: low density lipoprotein receptor-related protein 8, apolipoprotein e receptor
  Uniprot ID: Q14114
  ENST ID: ENST00000347547
  CDS Start-End: 1-2382
atgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctga

SEQ ID NO: 149706 - DNA, 2553 bp, Homo sapiens
  Payload ID: 9573
  Gene Symbol: LRP8
  Gene Name: low density lipoprotein receptor-related protein 8, apolipoprotein e receptor
  Uniprot ID: Q14114
  ENST ID: ENST00000354412
  CDS Start-End: 1-2103
atgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctcactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagt

SEQ ID NO: 149707 - DNA, 3322 bp, Homo sapiens
  Payload ID: 9573
  Gene Symbol: LRP8
  Gene Name: low density lipoprotein receptor-related protein 8, apolipoprotein e receptor
  Uniprot ID: Q14114
  ENST ID: ENST00000371454
  CDS Start-End: 143-2857
gccggggcgggcggcagcggcggcggcggcggcggcgggggcagcggcaaccccggcgccgcggcaaggactcggagggctgagacgcggcggcggcggcgcggggagcgcggggcgcggcggccggagccccgggcccgccatgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgacgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgtccgggccccggggccacgtccgcgcccgccgcctgcgccaccgcctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagtaaaaaaaaaaaaaaa

SEQ ID NO: 149708 - DNA, 660 bp, Homo sapiens
  Payload ID: 9573
  Gene Symbol: LRP8
  Gene Name: low density lipoprotein receptor-related protein 8, apolipoprotein e receptor
  ENST ID: ENST00000529670
  CDS Start-End: 1-365
tcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgacacttgggttgaattcagtaagtttcctctgaagcaccctgaagggtgccatccttacagagctaagtggagacgtttccagatcagcccaagtttactatagagactggcccaggcactgaatgtctaggacatgctgtggatgaagataaagatggtggaataggttttatcacatctcttatttctcttttccccttactctctaccatttcctttatgtggggaaac

SEQ ID NO: 149709 - DNA, 3231 bp, Homo sapiens
  Payload ID: 9573
  Gene Symbol: LRP8
  Gene Name: low density lipoprotein receptor-related protein 8, apolipoprotein e receptor
  ENST ID: ENST00000480045
  CDS Start-End: 159-1337
gaaatgcagccgaggagccggggcgggcggcagcggcggcggcggcggcggcgggggcagcggcaaccccggcgccgcggcaaggactcggagggctgagacgcggcggcggcggcgcggggagcgcggggcgcggcggccggagccccgggcccgccatgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctaccttgtgcgccccgcacgagttccagtgcggcaaccgctcgtgcctggccgccgtgttcgtgtgcgacggcgacgacgactgtggtgacggcagcgatgagcgcggctgtgcagacccggcctgcgggccccgcgagttccgctgcggcggcgatggcggcggcgcctgcatcccggagcgctgggtctgcgaccgccagtttgactgcgaggaccgctcggacgaggcagccgagctctgcggccgtccgggccccggggccacgtccgcgcccgccgcctgcgccaccgcctcccagttcgcctgccgcagcggcgagtgcgtgcacctgggctggcgctgcgacggcgaccgcgactgcaaagacaaatcggacgaggccgactgcccactgggcacctgccgtggggacgagttccagtgtggggatgggacatgtgtccttgcaatcaagcactgcaaccaggagcaggactgtccagatgggagtgatgaagctggctgcctacaggagtcaccctgtgagggtccccgcagatttcagtgtaagagtggcaagcgcgtggacggcgggaaagtgtgtgatgtgcagagggactgccgggactggtcggatgagcttctgaaagtgtgggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcagcaatcagcagctttgatcgcccactgtgggcagagccctgtcttggggagaccagagaaccggaagacccagcccctgccctcaaggagctttttgtcttgccgggggaaccaaggtcacagctgcaccaactcccgaagaaccctctttccgagctgcctgtcgtcaaatccaagcgagtggcattaagccttgaagatgatggactaccctgaggatgggatcacccccttcgtgcctcatggaattcagtcccatgcactacactctggatg

SEQ ID NO: 149710 - DNA, 627 bp, Homo sapiens
  Payload ID: 9573
  Gene Symbol: LRP8
  Gene Name: low density lipoprotein receptor-related protein 8, apolipoprotein e receptor
  ENST ID: ENST00000481431
  CDS Start-End: 1-406
ggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgaggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagag

SEQ ID NO: 149711 - DNA, 721 bp, Homo sapiens
  Payload ID: 9573
  Gene Symbol: LRP8
  Gene Name: low density lipoprotein receptor-related protein 8, apolipoprotein e receptor
  ENST ID: ENST00000475501
  CDS Start-End: 1-721
cagatgggagtgatgaagctggctgcctacaggttccgccaacattcctgggaaacaggaggaggcccagggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagg

SEQ ID NO: 149712 - DNA, 2670 bp, Homo sapiens
  Payload ID: 9573
  Gene Symbol: LRP8
  Gene Name: low density lipoprotein receptor-related protein 8, apolipoprotein e receptor
  ENST ID: ENST00000465675
  CDS Start-End: 847-2220
agacccctgcgcgcggcggagagagagggggctgcctgccagggtgatgtgcctgcggctcccactgcgcctggcgcgcgggcgcggggactccctatgggctgtatctgagcagatctctgactatgggtcgcgtgtgcggggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctcactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgctggcaagagcccatccctaatcttcaccaaccggcacgaggtgcggaggatcgacctggtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagcacctcaatctacctcaactacgacgttagcttctaccatgacgaggacagtacctgccaccacaagagcccccgggaccaccgtccacagatccacctaccagaaccacagcacagagacaccaagcctgacagctgcagtcccaagctcagttagtgtccccagggctcccagcatcagcccgtctaccctaagccctgcaaccagcaaccactcccagcactatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagt

SEQ ID NO: 149713 - DNA, 2550 bp, Homo sapiens
  Payload ID: 9573
  Gene Symbol: LRP8
  Gene Name: low density lipoprotein receptor-related protein 8, apolipoprotein e receptor
  ENST ID: ENST00000613948
  CDS Start-End: 1-2100
atgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctcactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacctgtggcgacattgatgagtgcaaggacccagatgcctgcagccagatctgtgtcaattacaagggctattttaagtgtgagtgctaccctggctacgagatggacctactgaccaagaactgcaaggctgctgctggcaagagcccatccctaatcttcaccaaccggacgggtgcggaggatcgacctgtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcaggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcacgagtggcattaagccttgaagatgatggactaccctgaggatgggatcacccccttcgtgcctcatggaattcagtcccatgcactacactctggatggtgtatgactggatgaatgggtttctatatatgggtctgtgtgagtgtatgtgtgtgtgtgattttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctgggggggcttttttaggttttggggcatttgttttttgtaaataagatgattatgctttgtggctatccatcaacataagt

SEQ ID NO: 149714 - DNA, 1167 bp, Homo sapiens
  Payload ID: 9574
  Gene Symbol: LRPAP1
  Gene Name: low density lipoprotein receptor-related protein associated protein 1
  ENST ID: ENST00000515119
  CDS Start-End: 5-322
gaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgaaacctcccggtggccagcctcctccgaggtcagtttctcgctgtgtcctggtccgtcctgctcgtggctcacaggctcctccccttcgttcgcagctgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggtaaggaaacacggccctctccttctagctctctcctgtggtgaagattctcttgcagtttccgggtaaggaaatgcagccctctcctccaagctctctctctcaagattctcgcagtttcttccttaaccactcggtgaacctgcttgcgttttccttctcatctgcgtgggaactcgtgtttcaggggcggggccaggctctggagggaggggctttggttcttttgtccgt

SEQ ID NO: 149715 - DNA, 7819 bp, Homo sapiens
  Payload ID: 9574
  Gene Symbol: LRPAP1
  Gene Name: low density lipoprotein receptor-related protein associated protein 1
  Uniprot ID: P30533
  ENST ID: ENST00000500728
  CDS Start-End: 148-1221
gctggagtccgccggcggcctcgccgctgccggccgctcacggaggaactacaattcccaggagaccgcgcggtgggtgggggcggggtagtgggcggggcatcggcaggctaggttttctccgcgcagcgccagtcgcagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccacccgcttgttggctggtcactaagtgtcctggtggctggggccggagccagtgctcttgaagggatcgcgtcatagccagcttcccctctgggccctgtgggtctttgcagccaacctccttttcccgtgagacggcccggcctgatttaaagccaagagcgcttgagttgagtttgaggggaagatgtggagcgtgtggttctgtggacagtcagagactgtggcctgggggcagcgtctttcaactctcacctctgcagctcagggacctcgggagacctcaccaaacctgcagggcctccgtgtccctaagtgtgctgtgtaaatgccccatctcatgggggagagacagccacggaggccttcctctgaccatagctgatggactggcggttgctcaggtccggctccgagaatgttcctgtgtctgagcctggaagaggctcgggtctggctccaggcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctccgagcgtggttcccttcccgtgtctgagcctggaagaggctcgggtccggctctgggcgtggttcccttcccgtgtctgagcctggaagaggctcgggtccggctctgggcgtggttcccgtgtctgagcctggaagaggctcgggtccgggtccagctccgagcgtggttcccgtgtttgaacctggaagaggctccaccaggcgtattgtgttttgactgcagctggatcttggcttgactgttgagatctgccaaacatccgctaagctatcatttctgagaaaggtcaaggctagaggcagcatgtcgggagttggcgcatcagggttggaagggccccagggtacagcatgtgggtgcctgttcctttgtggacttgtgtgtgtgtggctggtggggcggggggtggattctggttcttttttttcccattatcctgagagccttaaggtactcagtgtgttggtgagactcagccctgtcatctagcagaagtgtgttccttttcattgctgtatagtattccattgcatgactgtcctgtgctctgattttaatgcactttattgtgggtggatatttgagttgcttcctttctggggtaataacactcacttggaaatagctgtggtgaacactcgtgtgggggtgggggtgggggccaactctaggagcacctaatggatcttacgaagcgtgttgtccaagtatagagatgattccaaagtggttggactgtgtttctttctcccagctgggtggaaggagaacactagtggattgctgagacttggtgctcggtatttttaattatggacagcctggctggcgttttgtggtgtctaattgcggagtagcgtgtcttactgtataatggcctcttttgtatgtgggagaccatggtgttgaggggaggcagttacacaaaaaacccagataccgagtgttagttccatgggtgtggctggtcatggtgcgcactcacgaaggatgtaggtgatgccctccactccgcagagccagtcccacaggggtacccattctgactcctaccaccgcagctccctacctcccgcctgccatgggttccacgtgcatggctctgggcagtctgtgtctttgcgtgcgtctgtgtatgtctgcgtgtatctgcttacattcgctcagcatctgagattcacccaggcttttgcgtggatcagcggcagactcctgattgccgcgtggcggcctgttgtgtgggtgtgtgccgcgtgtgtatccagtccctactcaggagtgtacgtttccagtgtgggttgcagtcaggatccatttctcccttaactttcagattatttgctgcataggcttttttctcctaatttggcgcctttgtcagaaatcaactgacctacctgtgtgggtctgtttctgtttgtccttacgctcttgccattgccacactttagacaaggtcttgctctgtccctcaggctggagtgcagtagcgtgatctcagctcactgcacccttgacctcccatactccagcaatcccctcgcctcagtctcctgagtagtagctgcgaccacaggcgtgtgtcaccacacccggctgattttattttttttatttttattttttttgtagagacggggttttactatgttgcccaggcaggtcttgatctgggctcaagtgatgctcctgtctcagcctcccaaactactgggattacaggttgtaggtgtgagccatggtgcccggccgccacactgtcttggctacagttgggtttataataaaccctgaatcgaggtgatgtgcattttccaactcttctttttaaagattcttgtggctgtttatgtccttggtgtttccatatatgttttacaatcagtgtctcaatttctaccaaaaaaacatgccttctggaatttcaatagcaattcccttgaacgcatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccagtgtccacgcgttgactgccgtgtgtgactccagtcggcgtctcagcagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccacgcgttgactgccgtgtgtgactccagtcggcgtctcaacagtctccggtgtccatgcgttgactgccatgtatgactccaggtattgagttcatcttcaacttctcccaacaatgaactggagttttctgtgcatgtgtctggcatgttttcctttagatctagtcctaggtgttcgatatgctattgaggactgtgtatttttatttcatttgtcacctgtgcgtggtgctttaatcctgtgccctaaactcccgccttggccatggcggtgtttctgtggactcgtggggtttccgtgtgcacacgcgtgtcctctgtctgacagtggctttgcttccccttgtcagtctgtgcctcggcttctcactgcactggtgaggtgagccggcgctcgctaatcttattcccagtctcggtgaacatgggctcagtctctcccggctcagtgttgggtttgcactggtgcacttacaggcagaagagcttcctcatttgctgagggcttttcctgaatccgtgttgaatgtggtcagctgcctttcctgcacctagtgagatgctcatgaggtcacttccttaccgcattactgtagtgaattacgctgactttcatatgccaagatgacctggcatttccaggtaagtccctgtggccatggtgcattggccttttctctgcatggccagatgagatttgctcataccgggctaaggacctcctgtgtaggaatgctcttgagggacactgggcttggatgttcattgtcttgtcatgtgatgtgtctgtcatggtttgatattgcattaagtgggcctcctgaaacaagttctgccatagtttgtataggattggcattatttgtttcatagagatgtgatgggtgaggccatctatgcctgccattttctttttgcttaggtttttcattaagaacttgatttttaaaaatagacatgaggcctggcatggtggctcacgcttgtaatcccagcactttgggaggccaacgtggatggatcacctgaggtcaggagtttgagaccaacctagtcaacatggtgaaaccccgtctccattaaaaatataaaaattagcagggtgtggtggtgcatgcctgtaatcccagctactctggaggctgaggcaggagaatcacttgaactcaggaggtggaggttgcagtgagctgagatcacaccactgcactccagcctgggcaacagagcgaggctctgtctcaaaaaaaaagacatgaggcttttggattttctgtttcttcctttgtcatttttttaaagataggtttgtcgcagaatttcatctaagttatcaaaacaatttacataaatcattcacagtatcctctgtgcagtgatgtccattctcattcctgctctgggccatttgtgttttcttttccccctgatcagactagctaagagtttatcatttttacagatattttccccaaagaaacctacttttgggtccattgattttttttttctattgttttctttttcattgacttttgctcttttcttatgaatttcctttcttctacctattttgtgttcaatttgctgtccttgttttaggttcttttgatagaggcttagatcattgatgaagaatatgaaagaatgggataatacagttaaaaacttggtctacttatgcccattagagaaaacattcttaagcacgcatggaatcttttaaaaatggacgaggtactaggacccaaagcaaatgtcagtaattcgcagatgataatgtataaatatatgatatgtaggtaaataatacaaatcacattctttggccagagtgcaattgaggaggaaatcagtaacaaaaagacaattaaatccatttgattcttttgttttcgttttgtagtaacttgcacttccctggtgccagaggcatgacacctttttgtctgctcttggccatttgggtggcgtctttgggaagggcctacttaattcttttgcctatttaaaaaactgggtcttggaaatcttgtctttttttttgagtcaggatctttctcgcacaggcttggagtgcagtggtgcgatcatagctcactgcaacctcaaactcctgggctcaagcgagcctcccacctcggtcttctgagtagctgggactacaggcatgcatcactatgctctgctaatttaaagaaaaggttttttttatagagactgggtctcgctgtgttgcccaggctggtctcggagtcctggtctcaagtgattcacctgcctccacctcgcggagtgccaggattacaggtggcgggagccgccacacccagcctggtcttagcgttattcccaggtctaggtgtgagtccttcctcagatatgtgttgtgaataatttccgatcctctggcttgctattttactttcttaatggttatcttttggaaagcaaaggtttccagtttgatgaaatctaatttttattttttatttttccgttctagtggtctttctattttctcatcaaattgagactttggggaaactacacagcagcaaaccaggatatatcctcttaaaaacagctcgagccggccgggtgcggtggctcatgcctggaatcccagcactttgggaggtggaggtgggcggatcacgtgaggtcaggagtttgagaccagcctggccaacatggtgaaaccccatctctactaaaaataaaaaattagccaggcatggtggcaggcacctgtaatcccagctacttgggaggctgaggcaggagaatggcttgaacctgggaggcagaggttgcagtgagccgagatcgcgccattgcactccggcctggggacaagagcaagacttcgcctcaaaaaaaaaaaaaaa

SEQ ID NO: 149716 - DNA, 9899 bp, Homo sapiens
  Payload ID: 9575
  Gene Symbol: LRBA
  Gene Name: LPS-responsive vesicle trafficking, beach and anchor containing
  Uniprot ID: P50851
  ENST ID: ENST00000357115
  CDS Start-End: 245-8836
agggaaacttggaggctgcgaccagggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcactcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaa

SEQ ID NO: 149717 - DNA, 10032 bp, Homo sapiens
  Payload ID: 9575
  Gene Symbol: LRBA
  Gene Name: LPS-responsive vesicle trafficking, beach and anchor containing
  Uniprot ID: P50851
  ENST ID: ENST00000510413
  CDS Start-End: 286-8841
atctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcactcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaactttgatctctatttctcttgcaacagacttcaagtggtccctctttttttcctacacactcagctcttctctaaaagcaaggatttggaatgaacaattcagtttgacagaaaaagctgaataaaat

SEQ ID NO: 149718 - DNA, 8826 bp, Homo sapiens
  Payload ID: 9575
  Gene Symbol: LRBA
  Gene Name: LPS-responsive vesicle trafficking, beach and anchor containing
  ENST ID: ENST00000507224
  CDS Start-End: 296-8023
cctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcactcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcataggtctgtcacttccttctctctttgcgattcattaagctctgtatggtggccctgaagtgtagattacagttgtttttcacttgctggttgctgggaatggaattttcctgataaaccatttgcatgcaaattggaatgcaatgagctgtggctatgctggtatttcatcaactccccctcgttggtttgcctaatttgaacaggcctaggacgcgtgtcactgaaaattaatatggatgctgtaataatgtgtgattgagaatgcgcatgaagtactgtcaggataatattggatcttttcatcactcagacttgttgatgagcaggagcaaggcacgttatgatgaattggtgcaccggtaatgtgatggagctcctttgctaggaaaattttcataataacagtggggttcttagcagcactgcgttatgaaaaataaaactgtagtgccagggtttcatcattaaaggagatcaatcctttcttcctagaccttctgttcagtctgaggggattaatgtgcaattgcagagcagtttcaaagttgaaatatattgcccagccaatggtagtgttaagatatttgtattcattttcctagggtcctacagcccaataaattgccattggaggttaaatttgttcaggggagaaaaaaatagggaggcgaccagaaagagccattgggatgaaatgagcatctgcagcagatgacttagaatatttaattgctgttaggctttttgagtagattagtcgaaatctctagtttagcatttttcatccttacgtgtggggatttcaaatgtggcatcactaagaatgttaagcctcgat

SEQ ID NO: 149719 - DNA, 814 bp, Homo sapiens
  Payload ID: 9575
  Gene Symbol: LRBA
  Gene Name: LPS-responsive vesicle trafficking, beach and anchor containing
  ENST ID: ENST00000502839
  CDS Start-End: 1-405
ggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacataactaagaagtcattacatatgaacctgcaaaatatcatagattttgtcagatcacggatcacaaatatgtcaaagaattgcatcaagtggatatgttcaaattgagcctatcttctatttttctgaaactgattatatccaaaatttttgacattaagtattaacaattagtctcatttttaccattagtttctatttacaggcatgcctcattttactgtgctttgctattgcatgttgccgattactggattttttacaaattgatggtttttggcaactctgtgttgaactagtctatccatgccatttatccaacagcatgtactttatgtctttatgtcatatattggtaattcttacaatatttcaaaccttttcattattattatttatctgtcatgctgatctgtcatcagtgatctttggtattactattgtaattgtcttggggcaccacaaaccacacccatttaagacagtgaacttaataaatgtctgactgtgctacaaa

SEQ ID NO: 149720 - DNA, 633 bp, Homo sapiens
  Payload ID: 9575
  Gene Symbol: LRBA
  Gene Name: LPS-responsive vesicle trafficking, beach and anchor containing
  ENST ID: ENST00000508606
  CDS Start-End: 1-443
gctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttg

SEQ ID NO: 149721 - DNA, 5578 bp, Homo sapiens
  Payload ID: 9575
  Gene Symbol: LRBA
  Gene Name: LPS-responsive vesicle trafficking, beach and anchor containing
  ENST ID: ENST00000509835
  CDS Start-End: 1-4517
gtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtg

SEQ ID NO: 149722 - DNA, 5283 bp, Homo sapiens; identical to SEQ ID NO: 148404
  Payload ID: 9576
  Gene Symbol:
  Gene Name: LRIG1
  ENST ID: ENST00000633161
  CDS Start-End: 605-3817

SEQ ID NO: 149723 - DNA, 5273 bp, Homo sapiens; identical to SEQ ID NO: 148403
  Payload ID: 9576
  Gene Symbol:
  Gene Name: LRIG1
  ENST ID: ENST00000631853
  CDS Start-End: 526-3807

SEQ ID NO: 149724 - DNA, 5157 bp, Homo sapiens
  Payload ID: 9577
  Gene Symbol: LRP2BP
  Gene Name: LRP2 binding protein
  Uniprot ID: Q9P2M1
  ENST ID: ENST00000328559
  CDS Start-End: 813-1856
gcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtccgatgagtgtcagttacaagggcagagaaggtaccagtgcagaagagctctgactgtgggcagtgtcaccaggtcccactaagtggcaacacttgtgctgggtgacttgacccatcttgatgtataaacccatagccagacaggacgtgcaaacaggtctcatggtgaatgcgatgctgtggaaaatgacatggagaatggctgtctctcagctagggaggagggtcttggtgtcctagtaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaatttttccagtggaaaaaggaaaagactgattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtattttacaggtgacatgttacttcgttcttgaattcgtacgctgttaagttttgcaacttgaaacctagacacaaggtcaaattgctggaagagtcctcagaggtccacctcttaccctacagactggccgagaccatatcaagtattaaaaccattctatacagcaagtatcgtttatcctttcttaaacaccgagtctccaaaaatacttagtttagctttagtttagtaagttcagaagtagaaacaaacttatttaaaaccatcatttgaaagtttaattctttaaatttgtctcttagttttgtgaattttgaataataatgtttaaattttgtttcagtcatttaaaatttaaattttcagtcatttaaaattttaaaaatttaaaatttcacaaaactaagggtaaaagacatttaaagaattaaacttaaataagtgtgtgcagcatttctacttctgaagttattaaagctaaaactgcactaagccttttgagacatcctttattcttaaaaagctcataaataattggcttattacatataaacttcaaaaaagtgggttataagacattgctttagaatcttgcccctccaaatcttccctcaaagatcttaatgagtaaaacaactgctacatacatatgcagaatgtgtaataaaacaaaaagcaattgctatatgaaaatattcgtaagaaaagtaaagcaaattgtttctttgtgcttcagctcattttccatatttttaaaaccctgtggtaaaagcctcaatgaaatcatttacaagaactacaattaaatattgttaaaattagcaaaaggctttccgtatatagatgacatctatgaaggcaaaaggtgacagtaaaaacagtaagatccatatgcataagattgtacaaggctattcatttgtgaaacaaatatacatatcgaagacaggtctcagagataccttaactattcctttttttataaacatattaaaggatgtggctttattttataaatcacaaccatcccaacagtggatttaaacaagatttctttttagtaatgggaaaatgcaattaatatggaggtgatagtcactaagaactgttgaatggcagaaaagtatttgctctcgttttatgttctggcttgtctgtattgcctgaacttcattttgtctttgtgtaagggaagaaatttcaacagactcgggtttgagatatcctcaaatggtcatgtatttctgtctcaaatctcttaataccacccatgtaacattccttcaaccacttgaagatccaaattcccaactagtattctcttctccacacttaatccagttcctaaagattattattattattattattattatttttttttttttgagacggagtctcctgacctaatcttagcccggcgcagtggctcacgtctgtaatcccagcactttgggaggctgaggcgggcagatcatgaggtcaggagtttgagaccaggctggccaacgtggtgaaaccccgtctctactaaaaatacaaaaattagccgggcgtgatggcggacgcctgtagtcccagctactcgggaggctgagacagaagaactgcttgaaaccaggaggcagaggttgcagtgagctgagatcgcgcaaattgcactccagcctcggtgacaagagcgagactccatctcaaaaaaaaataaaaagaatcttaaaataggaacataataaaagatcggccctaagtaaagagcactttttaaactgccattaaagatgggtttcagaaatcataaactttgacgtgtgccatacatggtaacatgctatgcttatatgtcttctataaatccaatgcagaatttaaaatttcagtttactctagttaccataaagctaatgctctggcacaagcgagtccctgcaaactaccactgctgaggacagtagtaaaccccttgacctgagactgcggtgagtctgtaactcgagtgcattgagacttccagatcattactcttacacacacacacacacacacacatacacacacacacactccttctctaagattccttgtagctgatatctcatggaaaaatgacattttatcataaataaatatagagacaaaataatagtgatctttctcattcgcaatgtaaacttaacagctacagtttaaatgatagcatagaattatgcctaaaatagacatttcccataattgtattgtgataagttcttcaggcttgacaacttcacattgcctctcttccttgaatgtattttatctggtcttttctatatagtcttttgaaggataatttttatcaatagccaactttgggtatttttttaagtgtcaaatatcatcatggtttgaaaaaaggataaaaaagctataactaaaaaaatcttaaggataacatttggtttactaatttttaatcatttatctttcagaacttgtttcttatcaagaagttagcaggtatgatatgtatatcatacgtatataaactggcataggttacatcctagggcatgaggggagtatctttcagggattcaaatggaatttttacctgttacttgtttaattgttttgttttcaatattcttggggattagacaggggaaggtattttattactgcataatagatggtgaaacccaggaaaattaagtacttgtgcatggccccactatcaataacacaaagtctgtactctggatctcccctaatgtccctgtggtctaaacggcttgataatacaaccgagcccctgaagtagctgccctcctctttccgctcccccatctcggccctgcccatactccaagggtcagctcccatctctcctccctaatgcctcacttcaagcactaatttggctctttctgctcactaaaaatcatatattttacagatttattttgtttctggagaaggcagcaaacttttacttccctgcagaagtagttaagtacatagtgttttctctaaaaaggcatttgataaatatttgaacagcctgtagagtttcaacctctttgagatataagtatcttaaatatcatagagcactgtgattcatttttatattttattgctttgaatgctcaaactatgggaaatctttggtaaaaataaagacaataaaatcttcacaataacttt

SEQ ID NO: 149725 - DNA, 685 bp, Homo sapiens
  Payload ID: 9577
  Gene Symbol: LRP2BP
  Gene Name: LRP2 binding protein
  ENST ID: ENST00000511404
  CDS Start-End: 226-685
aaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccagaatacacattgcagaaaaaggatgaagttgaccagtgaaaagttgcccaagaaccccttttatgcctctgtatctcagtatgctgctaaaaaccaaaaatttttccagtggaaaaaggaaaagactgattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatg

SEQ ID NO: 149726 - DNA, 3055 bp, Homo sapiens
  Payload ID: 9577
  Gene Symbol: LRP2BP
  Gene Name: LRP2 binding protein
  ENST ID: ENST00000510776
  CDS Start-End: 1973-2938
gcaatttattgtctaaaatagcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaactgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtccgatgagtgtcagttacaagggcagagaaggtaccagtgcagaagagctctgactgtgggcagtgtcaccaggtcccactaagtggcaacacttgtgctgggtgacttgacccatcttgatgtataaacccatagccagacaggacgtgcaaacaggtctcatggtgaatgcgatgctgtggaaaatgacatggagaatggctgtctctcagctagggaggagggtcttggtgtcctagtaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaatttttccagtggaaaaaggaaaagactggtacaaatcctgatatttaagcttcccttggaaaacactttaacagttcattttgcatgctagagcaaacgagacaagaaataatgtgttttattgatttcaaggaagtggttaatcattagtccttttgagttttcccgcaagaatctgtgaaattgctcatttatctggtagcaaatcgtcagtgaggtctcacagatagttaggtcttgattttactctcaggacttaaggacatgcttctagaaaacagaaagcagatgtcacgtttgttaaagagaacaatgccaggcttgacttgcaattattatttaaataccttatcttccctaaagtcttaaaaatgttatattagggatgggttgctcatttggttagaggaactctcattaaggctcaaattaagaatttaactcacctctccagagagctttgcccattgaagacaaaccaatgcatagacttatacccagccctgcactgttagggctctacttggccatgagcagggttagtgtgaaaccaatcaacaagtattgtttgttgttgttgttgttgttttgagatggagtttcgctcttgttgcccaggcttgagtgcagtgatgcaatcttggctcaccgcagcctccgcctcctggggtcaagctattctcctgcctgagtctcccgagtagctgggattataggcatgcaccaccacgccctgctaattttgcatttttagtagagacggggtttctccatgttggtcaggctagtcttgaactcccaaactcaggtgatccacccgcctcggcctcccagagtgctgagatttacaggcgtgagccaccgcgcccggccagtattgctttattacacaaggcacagtgttagggcctgtgaccatgacgttttttcaggtaatatttcttccttgagctaaggaggccagttgtaggaatgagcactagaaagcaagaatgtcaacagtgttagatggattttatatgattcattacttcaagagagaaaattcatattgtgtggttgatggaattccttacctttttaaaatcagattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtatttta

SEQ ID NO: 149727 - DNA, 2302 bp, Homo sapiens
  Payload ID: 9577
  Gene Symbol: LRP2BP
  Gene Name: LRP2 binding protein
  Uniprot ID: Q9P2M1
  ENST ID: ENST00000505916
  CDS Start-End: 1143-2186
aaggatctgcttagaaaccaaagctccagccgagtgtttcttttcccctacatttttagtgattcccttctgttgatgcctttgaaagctcggagaaataaatacgtttattgttatgctgttagaaaacaagttcatgcttgtcctctaaagataagtggtcttttcattctactttttgttttgtagtaagagccataaaatttgcaatcgcaagtttatgttgttatacttagttacccaaggggtagttttaagcatttttattcatatgaatatttgaatataaatgtgtgttcaaatatatagaatcgttcttatattccacatttttaatatttaaactattcacaatatcttttaatgatgtttaaagaacggcagtgtagagatactgttgtcagatttgtgaggtgagcacacgttgatattgccagtttcgcttttgtttatcaattcaataagcactgctttttaaaacacgtgttgaagcttcaggtttgcacagaagttcattttcaggaattcctaactaataaagggtatcagacacgttcttacagttttgaacataaatactgcagttagcatatgtagtgggatatttgtgtggtgaaagtgcctccatatttcatatcttttctttgaaacaagattctgttcagtatgcattaagtggtagttattttttaacttcctgttacatacgtaaatttcataaggaaaggaaatttggggagtcgttacagcttttctccctttaatcacagcgtacctgtccattgctcacattgttttcagaaaaaaaagttgtatctcagctggatatctgacttgactttagtaatgggcctagaaactataaactgaacaaagcttataatgcacaaaaacaggataagtacatttgggggacaatatcttactggcaagtaactggagtttcaccaggcgtgtagcaggtgggatcaattttctaaaacggaagatgatctaagatgcatattttataggcgttctcctaagcagtgctaattctacatgttttaattgctggtagatgcgtttccagaacgaggatgccatttacagcgagtgttaaaaaaaacgttggatgatgaaatacacattgcagaaaaaggatgaagttgaccagtgaaaagttgcccaagaaccccttttatgcctctgtatctcagtatgctgctaaaaaccaaaaatttttccagtggaaaaaggaaaagactgattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatgggaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtatttt

SEQ ID NO: 149728 - DNA, 2585 bp, Homo sapiens
  Payload ID: 9578
  Gene Symbol: LRRN4CL
  Gene Name: LRRN4 C-terminal like
  Uniprot ID: Q8ND94
  ENST ID: ENST00000317449
  CDS Start-End: 479-1195
ggatttttaccaaaacagcattttgcggctcaggcccgtgctgttcgcagctgttttcctctaatatcagccaggtggccgccttctatgttcccctccccatcccgttgtatgacttcagccttcggattctaagctcctggctgctttccacattccactccccttccagaacccaggcatcctgggctccagctgaaaccattgcatgtggctttccccatccctggccccgtgactcagtccctctgaagggagcagccctcttttttggcaatcaccagggaggtggggggaggaggaggggagctaggtggtgacatcacagtcgaaggttataaaagcttccagccaaacggcattgaagttgaagatacaacctgacagcacagcctgagatcttggggatccctcagcctaacacccacagacgtcagctggtggattcccgctgcatcaaggcctacccactgtctccatgctgggctctccctgccttctgtggctcctggccgtgaccttcttggttcccagagctcagcccttggcccctcaagactttgaagaagaggaggcagatgagactgagacggcgtggccgcctttgccggctgtcccctgcgactacgaccactgccgacacctgcaggtgccctgcaaggagctacagagggtcgggccggcggcctgcctgtgcccaggactctccagccccgcccagccgcccgacccgccgcgcatgggagaagtgcgcattgcggccgaagagggccgcgcagtggtccactggtgtgcccccttctccccggtcctccactactggctgctgctttgggacggcagcgaggctgcgcagaaggggcccccgctgaacgctacggtccgcagagccgaactgaaggggctgaagccagggggcatttatgtcgtttgcgtagtggccgctaacgaggccggggcaagccgcgtgccccaggctggaggagagggcctcgagggggccgacatccctgccttcgggccttgcagccgccttgcggtgccgcccaacccccgcactctggtccacgcggccgtcggggtgggcacggccctggccctgctaagctgtgccgccctggtgtggcacttctgcctgcgcgatcgctggggctgcccgcgccgagccgccgcccgagccgcaggggcgctctgaaaggggcctgggggcatctcgggcacagacagccccacctggggcgctcagcctggcccccgggaaagaggaaaacccgctgcctccagggagggctggacggcgagctgggagccagccccaggctccagggccacggcggagtcatggttctcaggactgagcgcttgtttaggtccggtacttggcgctttgtttcctggctgaggtctgggaaggaatagaaaggggcccccaatttttttttaagcggccagataataaataatgtaacctttgcggtttaagaggataaaatggaggatattattatgtgggtatttatatgacctttgtaaccatttaaaaatgtaaaaacgacctgacttagtaatgcgaacctatagtagcagctactccagaggctgaaatgggaggatctcttgagcccaggagttggagtccagtccagccagggcaacacagccagacgcccttgttttttattttgttttgttttggttttttgttttttgaggagtttccctctgtcacacaagctggagggcaatggcgccatctcagctcactgcaacgtccacctcctgggttcaagcgattctcctgcctcagcatcctaattagttgggattacaggcgcccaccaccatgcccggctaatttttgtgtttttttagtagagacggggtttcaccatgttgtcaggctggtctcaaactcctgacctcaggtactccacccgccttggtctctcaaagtgctgggattacaggcataagccactgtgcccaggcagacccccttctttaaagatgtaaaacccggccgggcgcggtggctcacgcctgtaatcccagcactttgggaggctgaggcgggcagatcacgaagtcaggagatcgagaccatcctggctaacacggtgaaaccccgtctctactaaaaatacaaaaattagccgggcatggtggtgggtacctgtagtcccagctactccggaggctgaggcaggagaatggcgtgaacccgggaggcggatcttgcagtgagcggagattgcaccactgcactccagcctgggtgacagagcaagactccctctcaaaagaaaaagaaaaaagatgtaaaaaccattcttagtttgtgggccttacaaatcaggccactggcccattgcttgtagttagttgatccatgtcatgcaccctaaaaatggctctgtcactgtgagtggcttcagtaggattttgagaataagtttatattcttgctaggtaaaacaaaacaaaaacgacagtaataccaaggaatctccccccccttttaccctccatttgtgtttattgcatatccactataacaacattaaaggacctttaaaaggaagtaa

SEQ ID NO: 149729 - DNA, 2548 bp, Homo sapiens
  Payload ID: 9579
  Gene Symbol: LSM14B
  Gene Name: LSM family member 14B
  Uniprot ID: Q9BX40
  ENST ID: ENST00000279068
  CDS Start-End: 161-1318
ccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaatttt

SEQ ID NO: 149730 - DNA, 811 bp, Homo sapiens
  Payload ID: 9579
  Gene Symbol: LSM14B
  Gene Name: LSM family member 14B
  ENST ID: ENST00000279069
  CDS Start-End: 141-811
gtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcggaaacaggcgaacaaggaatcgctccagagggcaaaaccgtccaactaacgttaaggaaaacacaatcaaatttga

SEQ ID NO: 149731 - DNA, 1239 bp, Homo sapiens
  Payload ID: 9579
  Gene Symbol: LSM14B
  Gene Name: LSM family member 14B
  ENST ID: ENST00000361670
  CDS Start-End: 494-1239
ggagcagggcggctcccgtcagcgggcctcctccccgccagcctggggggatccctgcgggggagcctcgaggtcgggtggcggggccagtgtcccggcgtctcccgaaggctgggggtggggtcacaacacgcgaatcctgcaagcctttctggaacttattagacagctggggccttgatcctgaacaaataccgcgtcctaatgcggcctcctgccaaggcagaagcatccgttggcagccagatgccccggtttaaacgtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaagggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccag

SEQ ID NO: 149732 - DNA, 1079 bp, Homo sapiens
  Payload ID: 9579
  Gene Symbol: LSM14B
  Gene Name: LSM family member 14B
  ENST ID: ENST00000370915
  CDS Start-End: 207-872
cctctcagagccccagtcgcgcgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaagggtaacagcagtttgggagaactgcatgctgtcttgcaaaccattctgagagcgaggggtaaagcagcagacagaatgacagtagctgtagcagatcatttgccaagcccatgcagccgctgagctgcttgttttgcttcagcatgtagtcctgattgatgaactctcagtgttaaagaagggattacgaagaatcagcggagtagtttgttctctctccctgggtccaggttctctgttgacctgtaccatgactaccacatacgggaaacttcactgttcacagaaagtcatttccctggggtttttgctgggtcctaaatgtgttcc

SEQ ID NO: 149733 - DNA, 1073 bp, Homo sapiens
  Payload ID: 9579
  Gene Symbol: LSM14B
  Gene Name: LSM family member 14B
  ENST ID: ENST00000400318
  CDS Start-End: 186-1073
cgccccttcttggttcgctcggtgcccgcgcaggcccctcgggcggtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagctgaacaagcgccctgatgaaggcgtgcggggtgatgggatggccttcgccgttctcacccgatgtctcgttgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaa

SEQ ID NO: 149734 - DNA, 1147 bp, Homo sapiens
  Payload ID: 9580
  Gene Symbol: LSM1
  Gene Name: LSM1 homolog, mRNA degradation associated
  Uniprot ID: O15116
  ENST ID: ENST00000311351
  CDS Start-End: 397-798
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaagtgtcatgttatttccaa

SEQ ID NO: 149735 - DNA, 700 bp, Homo sapiens
  Payload ID: 9580
  Gene Symbol: LSM1
  Gene Name: LSM1 homolog, mRNA degradation associated
  ENST ID: ENST00000523511
  CDS Start-End: 169-303
ggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttggaacttcatgttcatgctaacatttattggatatctgcgaaatcactggatttgagcatgaggaagaaaccaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgac

SEQ ID NO: 149736 - DNA, 975 bp, Homo sapiens
  Payload ID: 9580
  Gene Symbol: LSM1
  Gene Name: LSM1 homolog, mRNA degradation associated
  ENST ID: ENST00000520755
  CDS Start-End: 355-489
gaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttggacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaagtgt

SEQ ID NO: 149737 - DNA, 850 bp, Homo sapiens
  Payload ID: 9581
  Gene Symbol: LSM10
  Gene Name: LSM10, U7 small nuclear RNA associated
  Uniprot ID: Q969L4
  ENST ID: ENST00000315732
  CDS Start-End: 151-522
ggacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaaactttggtggcaagggccaaggccggtgggaatttcccccaaaaaactgtaagtgaggccctcagcaagccctggccccaactcggagtcctccagtgatctccggagctagttccctgccctcacaccctgtctggtacccgagaagaaagcagggccaggccagaagctggtgtccaacagacaccacctgtcaaagctgcctttcacagggttccacctcccagactcactctgggacccagaatcctatatgtggccttggggtaggtgacaatccccctttttgatgatctgaatctctgacttattgattatggaacctgtcaagtagttttcaactctcccagtgaggataattaaacatgctcagcctgagccacc

SEQ ID NO: 149738 - DNA, 6584 bp, Homo sapiens
  Payload ID: 9582
  Gene Symbol: LSM11
  Gene Name: LSM11, U7 small nuclear RNA associated
  Uniprot ID: P83369
  ENST ID: ENST00000286307
  CDS Start-End: 57-1139
cctctggcggcttcgttccttcttcccatcggcctcggcttgcgggcctttcaaacatggaggagcgggagcggggggcgaggtcggctggcgccgggagccccgcgcgcccgcccagcccgcggctggatgtcagctctgacagcttcgacccgctgctggccctgtacgcgccccgcctgcctcccattccctaccccaatgccccctgcttcaacaacgtggcggagtacgagagcttcctcaggaccggagtccggggcggcgggcgcgggcgcgggcgggctcggggcgcggccgcgggctctggggttcccgccgcacccgggccctcgggcaggactcgtcgccgcccggacgcgcccgccccggaccccgagcgcatccagcgcctccgccgtctcatggtggccaaagaggaaggggacggggccgcaggagcgggccggaggggtccgggtcggagcaggaaggcgccacgcaacgtgctcacgcgaatgcccttgcacgaaggcagccctctgggtgaactccatcgctgtatccgtgagggggtgaaggtgaatgttcacatccgcactttcaagggacttcggggcgtctgtacaggcttccttgttgcattcgacaagttctggaatatggcacttactgatgtggatgagacctaccgaaaacctgtcctaggcaaagcatatgaacgggattcttcactgactctcactaggctatttgatcggctgaaacttcaagattcctccaagaaggaagcagattctaagtctgcagttgaagattccactctgtctagatactcacagacatccacttggaagttggcttcagtgtggggaagagcagacactggccggggctcacacaagcgttcccgctctgtcccttcttccctgcaggcctctgcaagggaggagtccaggtcagagctgtcagggaggactacacggacagacggctccagtgtgggaggtaccttttccagggctaccaccctttccagaggccagtcccgtaagaaaaagcgaaagcccaaagtggattaccagcaggtattcactcgacacataaatcagattttcattcgaggcgagaatgtcctgctggttcatcttgcacagtgaccagctcagcctgagctttggtttttagaaataaagtgcatgaattgctgctatgctgtatcctagtatcccagtgaaactctgagttggaatgattccctctggtcctgcatatgcagaggacggagcaggctcagccccctggaagatgagctcaaggggaggacaggccttgggagggcaggcgtttgcattaatatcaaggcaaaaagcattcatagatacatgcatctgatttggtattgtgatttacttcagaccctgaaaccaaatatctgatcttccattagacttaggggtcatgatatgagtggaatttacattttagatactataggggaaagaaaagtctcaaaaagaagtattgcatgtctaaaagctagtgccctgagtactcatgaattcgattccaagagtagtggtgtaaattgccttggagccctgcatccacgtcttgtaactaacttttgaattttgcctgacatgattctctcttgatgaagaaatgacatatattatctttgaatatctacaaggaaagttaccaacttatgtaggggtgaaatttggataggcggtatgctcaaagcagccagcaatgagtgctctgttttgatccttcttcttattatggaaaggagtacaggacctcttcagtcttccccttaccagaggtagcctctgcaaatggcataccagatgggactctaagatgcttgtgtggtggcttcttgtccttctctttgacttctgtggcatggtgctagtgcatgtaccctgtggtattgcccctctgtccgtagtgtgaactgtcctgtgagctttatgtcaggagactgtgaccttcatgtccagcttcaaagagttgtgcatgaactcggtaatacacatcacacggctgagagtcccctttccaggcagggccagcatgtgtagaatatctttcagaatatggtttcaccatgaaacaggggtggtagatttattcccttgtgtcaggccaaagaagttcttacaaagtacagtgggtagtgtctaaagcgacactttactcacagcctggcttgagtcaacaggaacaccatagcacccacaaatacttctacttgaatcatattctgtgctttttcaatcactagtgcagaataggctgcatttgacacagactgttaggcaatattgatttttttgttttgtttttatttggttttatctgagataacttatgttcaaggtgagaataagaaatagccaactagttaaaatgtatgaaaagaaaactttcccctgctgtatttgttgtgtaacataaataagccttctgagaagcagggtgaataaagtttagggagctgggacacctggtcctgctagctggaccactggctcatcatgcaatgaaaaggtgagcagacttaacccctccgtgcctcagctttttccccacagacacctacctcacaggggcattgagaaaaaaaaaatgaaggcattttacagtctctaaacatctttaagtgccatgagtaatttttcctgactctgtttcatagctttgtaagaattctgtgtctttataagacacagaagcaaggcaggtgctacataaaaaagtaatctcagccaggcacggtggctcacgcctgtaatcccagcactttgggaggctgaggcgggtggatcacaaggtcaggagatcaagaccatcctggctaacacggtgaaaccctgtctctactaaaaatacaaaaattagccgggcgtggtggcgggcgcctgtagtcccagctacgtgggtggctgaggcaggagaatggggtgaacccgggaggcggagcttgcagtgagccaagattgcaccactgtactccagcctgggcgacagagcaagactctgtctcaaaaaaaggaaaaaaaaaaaaagtaatcttagggttcatagttatgatcctgttgtaactatcttcggaaggcagcagtatcttctggaacttccatattccattccttcctcctaagggacaatggaagttctcagaagagtatcttcagtaagaggagagtaactttttttttgctgctcccgctatatcccaggcctcacccttttctgatcattatcagaaagaatcccctgaacttttcaaggggtttatatggtagcaccaaatggagaatgagcatctaaaaatgacacatcccgaaagggcaatctgtggaagtttgttgtttgtttgtttttatttttaaatgcattgtaaagtgtactctagagccagatcaggtgcactaaagtttatagaggttccagtttacaaactcaagtgaacagtaatctttggaagctgccagtctaaattctaaatagtgtatctgaaatctcagttcccaaaatagttgtcaggtttaatcatcaggcaacactgcgtatacctgtgtggctatcctcatctgcctgccctctcatccctcggctagaatgatgtactctactttcccaataaggtagaaatttggaatccaacggaatataatcagttttcattcattccagtgcctagttaaatctaacctgacttaaacatatgcctgtttttatgtttacctataattttcatatagccgtataaggattgatttaccattttttgcccaacatgacaattctggctatgaaaattatgtttaaactgtgtatgatctattttatgtgctctatgttcccatttgtttgtttggtctggacagtggttctggaatgaattctatctagtaaattagtaaatgtgctgttttgtataaagcatgataattactttttaacagaagttcatttttaaagattactcccttttctttctctcttttttttgagacaatttctctcttgttgcctaggcagtgcagtggcgcgatctcagctccctgcaacttctgcctcccaggttcaagcgattctcctgccttagcctcctgagtagctgggtcagccaccatggctgactcattttttgtatttttagtagagaaggggttttaccgtgttagccaggctggtcttgaactcctgaccttgggtgatccacctgcctcagcctcccaaagtgctgggattacaggcgtgagctatcccgcccggtccccttttctttattatcgaagatattgtttaaaagaaagaaaaagtaggtcccaataatatatgtgctattcaaaaaatgtgatcatttaggacattatcacaagttgctatggaaataactgaagacttcctcaggagaaggaaagaaaatgaggaacataatgatagagtcggggaactcccactagctcacctgaggggggctcgatgcagctgaaatactgaatactgaaatactagaaaccaacaaaactggtttctagaattctccagggatttgggcttgggaaacttggtaagaatagtttttatttttgaacattcaactttggttcttcaaagtaatctttaaacatgggaatatgttttcaagacaatttataggacatacttatgtagttggtgaggtcttctcaaaagtatctacctttgttagataataacaagtgattaagaaaggggagatatggttttatactcataacaatttcctgtgccattctctgtacacagaggtgattcatttactctcccattagtagaacttgcactttgggctgtctgttctagtatttgggaagtgtttatgcttccttccagggaccatcttatgatcagaggcaggatgtctgtgagatggttagctagagttagcagtgtccggggagagtggctttagaccagtcagtaccttgctctttgtgcatggtgcatgtcaagtcaggaagccaagaaaccgttggcattaaaatctagatgcatagagatccttgctatgagttgtggataggagtggctccatctatccttgtggtgaaagagtccaggagctcctttagagattgtcaagtcctgagcgatgagctgcccttaatcctcagaagccttacaaaaattgagatgtaccatttctaccctttgagaaaaaagaaatagaaacttacttgatgcagaatggatatttatatttctgcttgcaccatttccatagcagctgacaaaggcaaaatcatgaaatagaatcatttctataaattgcttctttaagttttctctaaattttgcctctaggaaaaaattaaaactattcaatgacagctagctgtcactggtgctaccccaaagctttccaatcttttatgtattttttgtgaatgaaactgttgctgtaggaaagtcaaggttcatgtaagagtatcgtggtgtaaatataatggtttcacagctgtttgaatttttcttttcctgtgccagatatagaatgcagtcaaccctttttcagtaacttatgttcaccagtctgtgcttttcttctcccagaaggcttttcttagtggttgtaaatgcaagaatcctgagccctgtgttgcaaaggtgggtggtctgtcagcactttctggcaaattgagttgatggatttaagataagcctttggggttcctgtcagttttctgggccctgaggaagggttgggcctcctttactctcagtattttgagtgtttttcaaatgtttgtacgttatcttgcactgctctaataaaaatgaaagctctctgacaagaaatagttctggatggtttgaagatctgcggggaaaaataagtgtgcacctgagaccttcagttagtcttttatttatttagaataaaaaatagtttgataacctaccagagttagtgcttctttaaaaacactccttggaaagatggggactgtcccttaggaaagccataaaagtgattcccaatactttgcaattgcttttgatttttagtcctttggaacaaatgtgtgatgttatgtctgatgttgtgtttttagagctgtgaaaagtctgaaaaatttcaaggggtattatttaaatgatgattatctggctgaattatgtgtgagctagaatctagggtagctgtccacttctttttctgttgtcctgacagtaaagcaaatagtaagccatgtcttgaaagtgatttgcttgtttcatactgacatctaaagacatcagccttctctttggcaaccctggggatactcctctgcaccataacttattaatgtttttttagacaaggctaaacctgaatgactctacgtatctatagtttcactgctcatataccagctgctacaagaaaaaccatgacttgtaagtttgtctttactcctaattgctaaattaactgaaacccttcctgtctagggagaattgctgctagtaaggtcagtttgcaatgttcagctttagatatgtgtcgtaatgggagtctgaaaactgtaataaactgtattcatatcctg

SEQ ID NO: 149739 - DNA, 2308 bp, Homo sapiens
  Payload ID: 9583
  Gene Symbol: LSM12
  Gene Name: LSM12 homolog
  Uniprot ID: Q3MHD2
  ENST ID: ENST00000293406
  CDS Start-End: 149-736
aggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatc

SEQ ID NO: 149740 - DNA, 942 bp, Homo sapiens
  Payload ID: 9583
  Gene Symbol: LSM12
  Gene Name: LSM12 homolog
  ENST ID: ENST00000585388
  CDS Start-End: 73-765
cggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaataagacagagtctcgctctgtcgcccacgctggagtgcagtggcgcgatctcagctcactgcaacctccgcctcccgggttcaagcgattctcctgcctcagcctcccgagtacctgggactacaggcgtatgccaccacacccggctagagatggggtttcaccatgttggccaggctggtctcgaactcctgacctgaagtgatctgcccaccttggcctcccaaagtgctgggattgcaggttgaaaaacattttagagacgtggaaagccaaaagatactgcaacgttcacaagcccagcaaccacagaaggaggctgccctgtcatcctgagtccgtacacatggaggactcttccagcatccagccaagga

SEQ ID NO: 149741 - DNA, 2484 bp, Homo sapiens
  Payload ID: 9583
  Gene Symbol: LSM12
  Gene Name: LSM12 homolog
  Uniprot ID: Q3MHD2
  ENST ID: ENST00000591247
  CDS Start-End: 324-911
agcagtaaatagcaccgtccttggaaataggcagactgtttttgctagttgtggaaccgtggacaagtttagtctaaaacttagtttatgtaaaaggaggacattgattcctacctcaaagggctgttagatgctcaagaagtgacaatacaaatgcctatgaagaaacaggatcaggatcccgccccaaccagcgccaggccacgccccggcgtgtgacgcaagcacgctccgtgcgcgccgtcgcgtcgcggcgctcactgggggcccggctttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttctttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatca

SEQ ID NO: 149742 - DNA, 3424 bp, Homo sapiens
  Payload ID: 9584
  Gene Symbol: LSM14A
  Gene Name: LSM14A mRNA processing body assembly factor
  Uniprot ID: Q8ND56
  ENST ID: ENST00000433627
  CDS Start-End: 76-1467
cgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaa

SEQ ID NO: 149743 - DNA, 3596 bp, Homo sapiens
  Payload ID: 9584
  Gene Symbol: LSM14A
  Gene Name: LSM14A mRNA processing body assembly factor
  Uniprot ID: Q8ND56
  ENST ID: ENST00000544216
  CDS Start-End: 78-1469
agcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttctgagatca

SEQ ID NO: 149744 - DNA, 2152 bp, Homo sapiens
  Payload ID: 9584
  Gene Symbol: LSM14A
  Gene Name: LSM14A mRNA processing body assembly factor
  Uniprot ID: Q8ND56
  ENST ID: ENST00000540746
  CDS Start-End: 119-1387
atgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaa

SEQ ID NO: 149745 - DNA, 2266 bp, Homo sapiens
  Payload ID: 9584
  Gene Symbol: LSM14A
  Gene Name: LSM14A mRNA processing body assembly factor
  Uniprot ID: Q8ND56
  ENST ID: ENST00000570462
  CDS Start-End: 106-1497
agcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaaaccacagcttttggaccctaaaaggtctggattgatcgtactgctttctgaaagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaa

SEQ ID NO: 149746 - DNA, 690 bp, Homo sapiens
  Payload ID: 9584
  Gene Symbol: LSM14A
  Gene Name: LSM14A mRNA processing body assembly factor
  ENST ID: ENST00000575388
  CDS Start-End: 1-243
acctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaa

SEQ ID NO: 149747 - DNA, 1032 bp, Homo sapiens
  Payload ID: 9584
  Gene Symbol: LSM14A
  Gene Name: LSM14A mRNA processing body assembly factor
  ENST ID: ENST00000575697
  CDS Start-End: 1-1032
ccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtggggga

SEQ ID NO: 149748 - DNA, 3519 bp, Homo sapiens
  Payload ID: 9584
  Gene Symbol: LSM14A
  Gene Name: LSM14A mRNA processing body assembly factor
  Uniprot ID: Q8ND56
  ENST ID: ENST00000575811
  CDS Start-End: 197-1588
gccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatataggaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaa

SEQ ID NO: 149749 - DNA, 559 bp, Homo sapiens
  Payload ID: 9584
  Gene Symbol: LSM14A
  Gene Name: LSM14A mRNA processing body assembly factor
  ENST ID: ENST00000575110
  CDS Start-End: 140-448
agcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagagtcgttggagtacagtggcgtgaactcggctcactacaacctccgcctcccaggttcaagtgattcttctgcctcagcctcctgagtagctgggattacagtcctcactaggctcatcgacttcttcattccag

SEQ ID NO: 149750 - DNA, 944 bp, Homo sapiens
  Payload ID: 9584
  Gene Symbol: LSM14A
  Gene Name: LSM14A mRNA processing body assembly factor
  ENST ID: ENST00000586157
  CDS Start-End: 1-944
ccttacatcggcagcaagatcagcctcatctccaaggcggagatccgctacgagggcatcctctacaccatcgacaccgaaaactccaccgtagcccttgccaaagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcagtcctcactaggctcatcgacttcttcattccagtccatgggttcttatggacctttcggcaggatgcccacatacagtcagttcagtccgagttccttagttgggcagcagtttggtgctgttggtgttgctggaagctctttgacatcctttggaacagaaacatcaaacagtggtaccttaccccaaagtagtgcggttggttctgcctttacacaggatacaagatctctaaaaacacagttatctcaagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatag

SEQ ID NO: 149751 - DNA, 559 bp, Homo sapiens; identical to SEQ ID NO: 149749
  Payload ID: 9584
  Gene Symbol: LSM14A
  Gene Name: LSM14A mRNA processing body assembly factor
  ENST ID: ENST00000589878
  CDS Start-End: 140-448

SEQ ID NO: 149752 - DNA, 445 bp, Homo sapiens
  Payload ID: 9584
  Gene Symbol: LSM14A
  Gene Name: LSM14A mRNA processing body assembly factor
  ENST ID: ENST00000585887
  CDS Start-End: 1-445
aagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatatagggtaagtgttactgttaataaattctttggggttgacatgca

SEQ ID NO: 149753 - DNA, 434 bp, Homo sapiens
  Payload ID: 9584
  Gene Symbol: LSM14A
  Gene Name: LSM14A mRNA processing body assembly factor
  ENST ID: ENST00000624888
  CDS Start-End: 1-434
gagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatatagggtaagtgttactgttaataaattctttggggttgacatgca

SEQ ID NO: 149754 - DNA, 876 bp, Homo sapiens
  Payload ID: 9585
  Gene Symbol: LSM2
  Gene Name: LSM2 homolog, U6 small nuclear RNA and mRNA degradation associated
  Uniprot ID: Q9Y333
  ENST ID: ENST00000375661
  CDS Start-End: 228-515
ccctttcccggcttcctcctcccctctactctacccagcttgcgctccccagccgcaagtcggccgcgctttgcccgtcagcgcttggagctttctgcgtcgcttcccgctgcgcctgcgcggtcccgcctcgccccacgcgcgggctcgcgcttcggtttccccagacctgctcgcagcaccctgctgtcttcccggtccggcccgctgcccgcggcgccagcaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaa

SEQ ID NO: 149755 - DNA, 876 bp, Homo sapiens; identical to SEQ ID NO: 149754
  Payload ID: 9585
  Gene Symbol: LSM2
  Gene Name: LSM2 homolog, U6 small nuclear RNA and mRNA degradation associated
  Uniprot ID: Q9Y333
  ENST ID: ENST00000383391
  CDS Start-End: 228-515

SEQ ID NO: 149756 - DNA, 876 bp, Homo sapiens; identical to SEQ ID NO: 149754
  Payload ID: 9585
  Gene Symbol: LSM2
  Gene Name: LSM2 homolog, U6 small nuclear RNA and mRNA degradation associated
  Uniprot ID: Q9Y333
  ENST ID: ENST00000424975
  CDS Start-End: 228-515

SEQ ID NO: 149757 - DNA, 876 bp, Homo sapiens; identical to SEQ ID NO: 149754
  Payload ID: 9585
  Gene Symbol: LSM2
  Gene Name: LSM2 homolog, U6 small nuclear RNA and mRNA degradation associated
  Uniprot ID: Q9Y333
  ENST ID: ENST00000434125
  CDS Start-End: 228-515

SEQ ID NO: 149758 - DNA, 876 bp, Homo sapiens; identical to SEQ ID NO: 149754
  Payload ID: 9585
  Gene Symbol: LSM2
  Gene Name: LSM2 homolog, U6 small nuclear RNA and mRNA degradation associated
  Uniprot ID: Q9Y333
  ENST ID: ENST00000432122
  CDS Start-End: 228-515

SEQ ID NO: 149759 - DNA, 876 bp, Homo sapiens; identical to SEQ ID NO: 149754
  Payload ID: 9585
  Gene Symbol: LSM2
  Gene Name: LSM2 homolog, U6 small nuclear RNA and mRNA degradation associated
  Uniprot ID: Q9Y333
  ENST ID: ENST00000455705
  CDS Start-End: 228-515

SEQ ID NO: 149760 - DNA, 3815 bp, Homo sapiens
  Payload ID: 9586
  Gene Symbol: LSM3
  Gene Name: LSM3 homolog, U6 small nuclear RNA and mRNA degradation associated
  Uniprot ID: P62310
  ENST ID: ENST00000306024
  CDS Start-End: 504-812
gcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcgttggaggcctagtcacgcccctaaaggaagctccaccccatacccgtggccactaaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaactctttcaggacttcttttgctccattattctcacagatacttactgatttttcttttctttaaattggtgtttccttgtagatttttttaagtgcggtcttctgtcttgtgaattatttaaagtaagcatgtcttaccttcacttagcacacatttgcagtgcacctactgtgtttgaggcaccaggtttgagtgctgggaaccagagttttatcaaaatgctttctgggccagacatggtggctcatgcctgtaatcccagcactttgggaggccaaggtgggtggatcacctgaggtcaggcgtttgagaccagcctggccaacatggtgaaaccctttctctactgaaaatataaaaattagccaggcgtggtggcgcatacttgtaatcccagctactcaggaggctgaggcagtagacgcttgaacccaggaggcagaggttgcagtgagccaagatcacaccattgcacttcaacctggtcaacagagcgagactccgtgtcaaaaaaaaaaaaaaaaaagttttctgccctcaagtcttctggggaggcagatgtttaaaccaacaattgcaggcagtaagattagtgctgatagaatcatgcacatgcaggatgccataggagcatggggaagagcacccaaatatgggagaaaggggcagagggacattgtaaacatcaaccctgcagtagaagacagagcaaagcatgatttctcttttctctggcctgatttaattctaaggtcagacgttcagcttgatcataacctgtttataattatgactcagaccatttttccactcttggatcattggccattaatgatgaggggtctcaaacaacatgtctcagtgacacagtaaagcagaaattggctgaaagcaaagctgtttttatttctagcttcagtcagcacataatgcttaaaacctaaagaggaaagtaaaagcgtgttacaatctctcaaactttatcaagacagggcttagaacctgacatcctccgctatggtcattccattttgaaatgtagaaaatccaacttgtggatggtttgtctgtaaatgagctgaatgtgtgtgcgtgttcattatcaagcacgatatgctcacaaatgcacagtactttaagccttgtgcaagaaagatgctttcagtaaacatatttaaaaggttttattttccttactaatggtacatgcccctgcaagttcatggagaagagaaaaacaagtgtgggtgagctgatggaggcttcatcttaggtgaggaggcaggagagacaccctcccttcacttgtgccatccccacgctttgtccttaagctgtagtggtcccaggagataacctgtttacagcagcccattcagtattgaaaaatgaactccctcctgcagaatgttagaagaaacaacctcaaagacctcaggccgcctgtggtcattagtatgtggcagcaagattgaacctgcctgcctcctacctgtgtgagcctgtggtgtgggtgtggtaccaaggccctggctctgggcagtctgttggctcctggtgttcactaaggcgtggggtgacaggccatctggcctcgctctgccagtctgcagttctccccagcactgcattcatttttagtggtttctgatagtcacactgaattcctggacactttcttctcttcattcttagttatctttctcctttttctcctggaactgatagtttacactaaaacttttggctgtgaggacttgattatacacatttctaaaacccatgaaccttaatatctgacactgttactctcatatgcacacacaactaaaacataccaacctacttcatttcctagctgctaagatacaaggggagggacaataaaaggttaactgcagaatagccacctatgtgtcaggaaatggagggaggggaggcaatgtgtgagtccttttggagctgggactcaatccacaacagagacagctcaagcagggccctgccatggtccacactgaggtttcctctgcagtggtgctgtccactgaggggttatggtgtgagggcccctgggagccacgccttggacttctgagtctgcagagcactcggctccagccagctggatggcaggtggtcagtggagctggtgactggtggtttctgcaatgaggtgtcagattagcctaagggaagcctcttcagcaagtatcatgcctggatcccggtcttggttgttttatgagaggccgatatgaattgccattgcctcccacaaagaaaaatggacaaaatatgggaccacatctttgagatgaaatgtgcccaaaatgaaaagtaacttgagtatcccaagttaaacttaatcattagctgcaaatggacgattttcaaatttcaaatagtgatttttgaagatttgcccaaactagagtactatccctcttcacactaagaggcagaaagtggtttcacacacccttttatttaatcagctaaagtgggtgcggtgacacacacctgtaaactcaaccactaaggagactgaggcgggaggattacttgagcccaggagttcgagatcagcctgagcaacataacaagaccctgtctcaaataatacttagctattacccatattgcttttagcctgctgccaggaggggagaaatgttattgtttgaacagatgtcagatgtgagtaatgctcagctgtgttcaatgtagaaaattaataaaagttccaggagtcatcctggctagatcaa

SEQ ID NO: 149761 - DNA, 1113 bp, Homo sapiens
  Payload ID: 9587
  Gene Symbol: LSM4
  Gene Name: LSM4 homolog, U6 small nuclear RNA and mRNA degradation associated
  ENST ID: ENST00000600289
  CDS Start-End: 41-250
gcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggtgaagaaccccaaccagagagagccccatcccaggctggagggagccccagtcagccactcctgagccaggcccacgggcagaggataggagccagtcttccttgacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaaactggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactaca

SEQ ID NO: 149762 - DNA, 1908 bp, Homo sapiens
  Payload ID: 9587
  Gene Symbol: LSM4
  Gene Name: LSM4 homolog, U6 small nuclear RNA and mRNA degradation associated
  Uniprot ID: Q9Y4Z0
  ENST ID: ENST00000593829
  CDS Start-End: 255-674
attacaagccgcggcactttacggctctcgtcctcgttcctccggcgggaacacggcccgccccgccctttcgcccagcgggccccgccctactccgcgtggattggttgaccgcccttcgagcccggtgctgactggcttgcgtctctgccactttctttcagcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaaactggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacacactgcacatccactgttccttttgagcttctgggtgcacctagcgggtctcctgccctctgtccatcgctggactctcaggaaatccccgttcccgtaagggaagcttccttttgagagttctcaccaggtgtcagcggcacagtgaggcactgatgtccttttacaaaaggcaagaccagcatctggacagtgggggctcttgagagtccccggcgccccccacaccaggttgtcctataaccctctcccctctgtggagacgttaatgccaaggggtgtgtggggagggaagtcccaggcaggggccacgcatggtccccatcaccccctcctgggtggcctggactccatcatctatcctcatctgtccacactggcgttcacacagagaagacaggacaggaatcccctcggaagatgctcatggaagattctcacgaggctcctgccccctttctgagccaggccgggtttgccactcctcgggcgcgcacctgagacactgagtcagcgctttcgagaaaggctccgggtagcatctgtggaccgtgaagaaaccagagggaagccctgagccaggcagcggcccgtccccctgcatagccttctcttcagggtcctcgttcggagacctattttgagaggtgattggaataaaaggtcccgtccgtgaggaactcttt

SEQ ID NO: 149763 - DNA, 986 bp, Homo sapiens
  Payload ID: 9587
  Gene Symbol: LSM4
  Gene Name: LSM4 homolog, U6 small nuclear RNA and mRNA degradation associated
  ENST ID: ENST00000252816
  CDS Start-End: 52-429
gtgcagcggcggcggcggaagtggccggcgagcccggtccccgccggcaccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaaactggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacacactgcaca

SEQ ID NO: 149764 - DNA, 446 bp, Homo sapiens
  Payload ID: 9587
  Gene Symbol: LSM4
  Gene Name: LSM4 homolog, U6 small nuclear RNA and mRNA degradation associated
  ENST ID: ENST00000597776
  CDS Start-End: 120-446
aatctgagaggcaggtgtgtgttccagggctgggcagagtgaggaaatggcatttccagtggggggtgattgacacgcactcctgtgccccctcaaccgcaccgcaccatctatgagtcatgggtgggactcaagaccagagctcccaggcgctggtcaaacagacaaatcatgtggctttatttgcctttcagcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggcc

SEQ ID NO: 149765 - DNA, 807 bp, Homo sapiens
  Payload ID: 9587
  Gene Symbol: LSM4
  Gene Name: LSM4 homolog, U6 small nuclear RNA and mRNA degradation associated
  ENST ID: ENST00000594828
  CDS Start-End: 93-807
agcttagtggcgcgcggcgcggcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcctgcagcagcagaagcagcagaaaggccgcggcatgggcggcgctggccgaggtgggtctcccctctccagtggacgtacctggggcgggaagacagccacacgtggcatccctccttcttggggttgcccttgcagcgctgcctcggagcctcccaaccctcccgggcccccctcctggtccttggccatgagccgaggcccaggcagaggagccccgagacctgggactcagccctcctctcactgcgcctcctggcggtcctcagggcacatcaagtcacctccccaagcctcagtttcccctctgagagggtatggtggtgcccatctgtccaggccgctggcaactccacttggaacctggcgtggctctatccagagccaaggtcgcccgcccccaccggagatgatgaattggcataaaattccatttgtta

SEQ ID NO: 149766 - DNA, 1295 bp, Homo sapiens
  Payload ID: 9588
  Gene Symbol: LSM5
  Gene Name: LSM5 homolog, U6 small nuclear RNA and mRNA degradation associated
  ENST ID: ENST00000223084
  CDS Start-End: 499-714
cttaaatcctcactaaagaaaaattttaaaaaatgctagttgcagattttcaatccactggactttaaaaagaaacaatagattccttaatgagtagttgtaacgaaaattgtaacagttaattgatggcaggaaatacgaattgatttatactggtttgaagattctggcttgagaggaaatgcaactttacgggggaagaagactcaaacgttacaggaacaatttattcacaaggcaaaatatcttcaacgtctctccaaaacttcaagggcattatgggtatctgccgagatggtaaaatgtccagtgggcaggaaatatttcaccggatctcacttgccggggaaaaaagccagtgaacgcgacccacgcagctgactagatcgtgcgctcggcctcagattggtcgagcctgtttgggctgcggaaaaagcggaagcgcgcttttcaaagtcgtcccaccatcaatgaaggcaggccacttccggcgtagccatggcggctaacgctactaccaacccgtcgcagctgctgcccttaggtaatcgccgtcctttggggagcaggaacagggagctgacattcaggattgggggccgaggggctgttccgaggcaggccctggccgagtgtggggaaatgtataagaccaaatgcggttcgactctgagctccaagtcttcgcgacagcaggccgcacctgctctttaacgtggtcgggctcctccaggcaaggactttgacttctcaaaccagaccttcactggaaaaggtccacatttagtgaacgcgtcgtcggcctactttgttgtgagcccgcctctgcagtgttatagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 149767 - DNA, 504 bp, Homo sapiens
  Payload ID: 9588
  Gene Symbol: LSM5
  Gene Name: LSM5 homolog, U6 small nuclear RNA and mRNA degradation associated
  ENST ID: ENST00000409987
  CDS Start-End: 16-210
acttccggcgtagccatggcggctaacgctactaccaacccgtcgcagctgctgcccttagagcttgtggacaaatgtataggatcaagaattcacatcgtgatgaagagtgataaggaaattgttggtactcttctaggatttgatgactttgtcagtatccttttaaaagtgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 149768 - DNA, 740 bp, Homo sapiens
  Payload ID: 9588
  Gene Symbol: LSM5
  Gene Name: LSM5 homolog, U6 small nuclear RNA and mRNA degradation associated
  Uniprot ID: Q9Y4Y9
  ENST ID: ENST00000409909
  CDS Start-End: 96-284
acgtgacccgggcggctgggcttgcagagcctgtggtgtccgcgggacctggagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaa

SEQ ID NO: 149769 - DNA, 687 bp, Homo sapiens
  Payload ID: 9588
  Gene Symbol: LSM5
  Gene Name: LSM5 homolog, U6 small nuclear RNA and mRNA degradation associated
  Uniprot ID: Q9Y4Y9
  ENST ID: ENST00000410044
  CDS Start-End: 273-461
cggctaacgctactaccaacccgtcgcagctgctgcccttaggtaatcgccgtcctttggggagcaggaacagggagctgacattcaggattgggggccgaggggctgttccgaggcaggccctggccgagtgtggggaaatgtataagaccaaatgcggttcgactctgagctccaagtcttcgcgacagcaggccgcacctgctctttaacgtggtcgggctcctccagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaa

SEQ ID NO: 149770 - DNA, 538 bp, Homo sapiens
  Payload ID: 9588
  Gene Symbol: LSM5
  Gene Name: LSM5 homolog, U6 small nuclear RNA and mRNA degradation associated
  Uniprot ID: Q9Y4Y9
  ENST ID: ENST00000409292
  CDS Start-End: 118-306
tcactggaaaaggtccacatttagtgaacgcgtcgtcggcctactttgttgtgagcccgcctctgcagtgttatagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtca

SEQ ID NO: 149771 - DNA, 649 bp, Homo sapiens
  Payload ID: 9588
  Gene Symbol: LSM5
  Gene Name: LSM5 homolog, U6 small nuclear RNA and mRNA degradation associated
  Uniprot ID: Q9Y4Y9
  ENST ID: ENST00000409782
  CDS Start-End: 240-428
acttccggcgtagccatggcggctaacgctactaccaacccgtcgcagctgctgcccttagttggtgaagagtgattgaactagtggtcgtggccgtgattgaaaagttttcattccttcatgccacagactcttttggaaggctcattatgtgccagatgctgtgcttgaactgagatttgtattataagacctaaaagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttg

SEQ ID NO: 149772 - DNA, 687 bp, Homo sapiens
  Payload ID: 9588
  Gene Symbol: LSM5
  Gene Name: LSM5 homolog, U6 small nuclear RNA and mRNA degradation associated
  Uniprot ID: Q9Y4Y9
  ENST ID: ENST00000409952
  CDS Start-End: 301-489
ggtgtccgcgggacctggaggtgcggcgtggcacacctgctttttcctccctggattcaatctcaaagcacttccttctcttttgccttctctttttcctcaaagttttcccacttccctcttctcttctgttttccttgctttttcacatcttttcggttcactctccgagtgtccgattccttcacctccttgcctttgcctctgtggcccccgtccttattcttaaatatgtagtaacatggagcatactggtgagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgc

SEQ ID NO: 149773 - DNA, 2258 bp, Homo sapiens
  Payload ID: 9588
  Gene Symbol: LSM5
  Gene Name: LSM5 homolog, U6 small nuclear RNA and mRNA degradation associated
  Uniprot ID: Q9Y4Y9
  ENST ID: ENST00000450169
  CDS Start-End: 54-329
gcttttcaaagtcgtcccaccatcaatgaaggcaggccacttccggcgtagccatggcggctaacgctactaccaacccgtcgcagctgctgcccttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagagcttcttctttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaatgaggatttttcttctgatttcaaattccatgaactcctattgaaaacaaacaatgtacaggtaatatatgcacattgtagaaatgcaggaattatctattggaattaccctaaagatagaaattttatctatttgcttataaaattgattcagaaggttattaccttaatgtagttattactgaattgccaggaaatgagtggagacagagctttaagataaaggatactaaaagcagctaagaactccaggactcaggtcaaatcaaggaactgataataagatcattgaactgtataaattaagtcaaagaactcctattaaaaacaaacaggtaatatatgcacatcgtagaattgtaggtaagcaaaaaggagaaggttgatcatgctttgctgtatgtcttcgtagactttctcagtccactctcagtacacgttttattttacttgctcatcctgattatactgtttttaccctccacttaagtcattttttgaatttaaatggtgaatatctttctgtgtcaaatatttcaacattaatatgtacatagtattaaatggatttactataaattatttagcctattcttactggccacagtagtctaactagatctttatacatttgtatttttctagaataaactcaaaaatgtgtaagatcaaagggtatatattgtgttgccaagaaaaagtttgtgccaatgtatatttttgccaggagtctttcatagtaccatttatatccttcccagcattagctgtgttctaccttctctcctctttgccatttttacaagaaaaccgggcatgtctaaagttttcttttcctttttttttttttttttttttttttggagagtctcactggaatgcagtggcatgatcttggctccctgcaacctccagtcaggctggtgtgccttgtcgcgatatcaacgcgacctccgcctcccaggttcaagtgattgtcctgcctcaccctcctgagtagctgggattacaggtgggcgccaccactcccatctaatttttatatttttagagagatggggttttaccttgttggccaggctggtcttgaactcctgacctctagtgatccacctgcctcagcctcccaaagtgccggtattaaaggcatgagccaccaggcctggcctaaaattttcttgattaattttgatctcatttgtattttgtaaatgacttatctgttgaggcttttgccattgagatgtttgtctttttcttactaatttgtaagaattcttgatgggtttctgttagtcatgtattttgctaataatttccctagtttgtagtttgccacttagtgctatttttgacataaatgatgtattttaatgtagttgcatgttgacctagtccattatggtttttgtatttggtccacgtggattggaaaacctttgctttgattatacttttctttgggcactttat

SEQ ID NO: 149774 - DNA, 768 bp, Homo sapiens
  Payload ID: 9589
  Gene Symbol: LSM6
  Gene Name: LSM6 homolog, U6 small nuclear RNA and mRNA degradation associated
  Uniprot ID: P62312
  ENST ID: ENST00000296581
  CDS Start-End: 138-380
gaagagcactgattggctgaggcagaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaacttaagtttcgagaagtgtcatttcatttgacttgcttttcttatccagctaaaatgatgcatatattttatatattgtatggacatataattaaaacattttggagg

SEQ ID NO: 149775 - DNA, 549 bp, Homo sapiens
  Payload ID: 9589
  Gene Symbol: LSM6
  Gene Name: LSM6 homolog, U6 small nuclear RNA and mRNA degradation associated
  Uniprot ID: P62312
  ENST ID: ENST00000504181
  CDS Start-End: 75-317
gatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacataatccttgcgtgaatatgttctacaaaggcatccagtttcagtctgaagctacaaaaaggggccacaggatcagaagttcagccactgattgagtcacctaaataaa

SEQ ID NO: 149776 - DNA, 1352 bp, Homo sapiens
  Payload ID: 9589
  Gene Symbol: LSM6
  Gene Name: LSM6 homolog, U6 small nuclear RNA and mRNA degradation associated
  Uniprot ID: P62312
  ENST ID: ENST00000502781
  CDS Start-End: 720-962
cgctttcggttttggctgggatcatccgcggcggccgggctcgtggggcgcctggagtgagggttctggttcccgccggcgaggtgagccgcaccgctgcgcgggccgacgacggggccgggcgcagccccaggttcggtgccccagtgttcagtcgcgctgtggagcggcggctgcagcggccctaggccgggcgaggcagccccggaaagggcctgcggtgaacaggctggggctccgggaagggaccgctgggtggcgggtccccgcgaaatgccgcgtccaagctctccgcgcatggaatggctgggagaggtctgatggtgggcgccgggaccgccctcagcgaggcgcctagactgcgcggagaggagcggcaccgtcccggctcctaccgagttggcgtccgagatcaattcaggttgttgaagttccccagggagccccgacgctaatcccaagattcggcgggaaagcggatcccgaacccaggcctaggcttcgcctgtcttccaggagggcttcagggaattgcgaaccctctcctacatcggggtggctgcgcctgaccacaggaattaaaggctggactcgcctgtcttaccaagttgtcaggtcgaggaacccgattgtatggtcttaagtcctatcgcccaaggttttctgtgcgtatgcgtgtccgcacacctgcatagcaggcatttttaaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatgtgagtaagataaatgtatacaattgtggatttaattgtgaaatgttctttcacttgtaagtttcagtcattttcttttacctcgttgtcagtgtacagaatgctaaaataattaaaaaaagacaaaatatacctcttcctacaagattatttaacttaagtttcgagaagtgtcatttcatttgacttgcttttcttatccagctaaaatgatgcatatattttatatattgtatggacatataattaaaacattttggaggaa

SEQ ID NO: 149777 - DNA, 545 bp, Homo sapiens
  Payload ID: 9589
  Gene Symbol: LSM6
  Gene Name: LSM6 homolog, U6 small nuclear RNA and mRNA degradation associated
  Uniprot ID: P62312
  ENST ID: ENST00000515311
  CDS Start-End: 120-362
gaggcagaaaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggatggctacatgaatatagccctggagcagacagaagaatatgtaaatggacaactgaagaataagtatggggatgcatttatccgaggaaacaatgtgttgtacatcagtacacagaagagacggatgtgaagacaccaagagagcaacgcttttcatagttggatatatttttttatgaattttttctaatttttgcttcttttgtgatacaatttgtcctctttttataatagttggtgatttttcactgacatagtctcactcccatcgcccagacttgagtgtagtgatgtgatcactgctcactgcagt

SEQ ID NO: 149778 - DNA, 529 bp, Homo sapiens
  Payload ID: 9590
  Gene Symbol: LSM7
  Gene Name: LSM7 homolog, U6 small nuclear RNA and mRNA degradation associated
  Uniprot ID: Q9UK45
  ENST ID: ENST00000252622
  CDS Start-End: 55-366
gggaggtcaaagggcgcggggcggtgcctgcgaagagccacacggcgcgacaagatggcggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctcaatgtg

SEQ ID NO: 149779 - DNA, 621 bp, Homo sapiens
  Payload ID: 9590
  Gene Symbol: LSM7
  Gene Name: LSM7 homolog, U6 small nuclear RNA and mRNA degradation associated
  ENST ID: ENST00000585395
  CDS Start-End: 1-183
gataaggagaagaagaaaaaggagagcatcttggacttgtccaagtacatcgacaagacgatccgggtaaagttccagggaggccgcgaagagtcacaggccctagcccacactccagaggaggggcaccttggctccatgttagagacctacctacctcagtgctcacatctctccccgtgaggagggcgggctcactggtcaggctggtgccaaggacctgaacatctgcatctgaccccatcttatagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctcaa

SEQ ID NO: 149780 - DNA, 512 bp, Homo sapiens
  Payload ID: 9590
  Gene Symbol: LSM7
  Gene Name: LSM7 homolog, U6 small nuclear RNA and mRNA degradation associated
  ENST ID: ENST00000585409
  CDS Start-End: 46-153
aagggcgcggggcggtgcctgcgaagagccacacggcgcgacaagatggcggataaggagaagaagaaaaaggagagcatcttggacttgtccaagtacatcgacaagacgatccgggtaaagttccagggaggccgcgaagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctcaa

SEQ ID NO: 149781 - DNA, 575 bp, Homo sapiens
  Payload ID: 9590
  Gene Symbol: LSM7
  Gene Name: LSM7 homolog, U6 small nuclear RNA and mRNA degradation associated
  ENST ID: ENST00000587502
  CDS Start-End: 266-415
gagccacacggcgcgacaagatggcggtgagcgcgcggcggaatctggagccggggggcgtggagctcgggccgcgctccaggtctcatgcgctctgctttccccgcaggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctcaat

SEQ ID NO: 149782 - DNA, 1305 bp, Homo sapiens
  Payload ID: 9591
  Gene Symbol: LSM8
  Gene Name: LSM8 homolog, U6 small nuclear RNA associated
  Uniprot ID: O95777
  ENST ID: ENST00000249299
  CDS Start-End: 193-483
gtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtcggcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagtttgtattg

SEQ ID NO: 149783 - DNA, 4030 bp, Homo sapiens
  Payload ID: 9591
  Gene Symbol: LSM8
  Gene Name: LSM8 homolog, U6 small nuclear RNA associated
  ENST ID: ENST00000424702
  CDS Start-End: 81-284
ctgccgggttctggcgcgccctttcagttctgcttgctgtcggcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgtgtaagtaaaatatatctgttaaaattataaatgatactgccttactttatggagaagaggctttccccaaaataccctactgtattgtccatacatagttaatagaatcttgcattcatttctttcgtaaatataccttttcttatgtttgtgtaaaataaggcatatgtatacattttatgtcagcacttctttaggtttcaaccaaagctgtctctctacaaattaaacttttacctgagatttgcccatttttctactagttaagtagcctgggtagagtccagaaagggctctgccttatattaaatacttcattagagagacttcttaaaacgttctttcaaatacccagaattttagaggaacatatttctagagtccaaggccaaagtttgaaaaatgttttgaaatctctgatttgaacaatattaattcatgctcaataacataggtgtatttataaataagtacttactcgttattcattttcttttaattttttagtatcattgacacacttaagatgtccctgtggcctcagtttacttgggacagacagatataaaagttcaagagtaattggccaggcatggtgcctgtaatcccagcactttgggagtctgaggcaagtggatcaggtcaggagttcaagaccggcctcgccaacatggcaaaacactgtctctactaaaaatacaaaaattagccaggcttggtggcgtgcgcctgtagttccagctacttgggaggctgaggtgggagaatcacttgaacccaggaggtagaggttgcagtgagccgagatcaccctactgcactccagcctgggtgacagattgagacaccaattcaaaaaaaaaaaggccgggcacagtggttcaagcatgtaatcccagcactttgggaggtggaggcgggtggatcacttgaggtcaggagttcgagaccaacttggccaatgtggtgaaaccgcgtctttactaaaaatataaaaattagccaggcgtggtggcgcaagcctgtaatcccagctactcgggaggctgagtcaggagaattcgcctgggaggtggaagttgcagtgagccgagatcgcagcactgcattccagcctgggcaacaagagcaaaactccgtgtcaaaaaataaaaaagaaaagtggctaatgtggttcacgtgccgtggctcatgcctataatctcagcactttgagaggccaaggtgggtggatcacctgagcccaggagttcaagaccagcctggccagcatagtgaaaccccgtctctccttaaaatagaaaaattagcctggtgtggtggtgcatgcctgtaatcccagctacttgggaggctgaggcagaagaatttcttgaacctggtagatggaggttgcagtgagccaaggttgcgcctttgcactccagcctgggcaaaaagagtgaaactccatcttgaaaaaaaaaagaaaagtggctgatgtgacagaggaactgaattttaaattttatttaattgtaattaattttaatagttacatgtggccagtattagtatagttatagaggctagaagaatgccaaatcagttttctagtgagtactacactgaatcaaaatatagttggaaagaagcaaaagatacattagcaattttaagctagaacatttaacaaattctaggggactaactgtcccctggaataacttaaaaagtgcaggaataatttactcatttaagttgtttatgttagcatcacctttagatgaataaataatttgatctgtaatcaaaaatcaagagtttataaaatattttagagatgacttttaggtggagttacaaggtgagctgtaagtaatgagagagagacagagcagatagggcccaggtctctggatcagaacaacactgtttatattggagctgtgcatagtaattgattttaaggtttctcctacttaaaacaatttttttttcttgaacttcagtgaaaaaagtcttgtgctagagccagcttctactggcccatgaaagcatattgttatattttaaggaattttacaagctggttaattgatgtcttgttagtagcttgaaattggccgtggtgggagtgtttgcacaatggatattagtaaatgcagcaaatcagtctcccgctttttttccagagagctggtttttaaaaatgtatcagcatttccctgcttaccatagggattttaaatgatactgaatattatcatttaaaatttaagaatatttaagagtggaattgaggcctttagtttgagaaaacttaattcattctgccagagtttcatatttttcatttattagatgatttaagactttatatactttaaagcaaaatttggcaaatcccttattactagtattcgtctttagaatttggccgggcacagtggctcacacctgtagtcccagcactttgggaggctgaggctggcgaattaccagaggtcagaggttcgagacctgcctagccaacgtggtgaaaccctgtctctactaaaaatacaaaaattagccgggtgtggtggcatgcgcctgtaatcccagctactcgggaggctgaagcatgagaatcgcttgaacctggtaagtagaggttggagtgagtcaagatcgtgccactgcactccagcctgtgcaacaagagcgaaactctatctcaaaaaaaaaaaaaaagaatttactctcattaaaaccaaacaaatgtaaacccaaccaatactttttaaaaataatatttcatagacatcttgtggtctgagtgataacattgaatatttccagttagagggctatgggttggttatctagcgtggtattaatgaatttaaagttatagatactatgttagtgttgaacaagaaaaaattttctagcttttaacctgagccaatcacgtcaaaaatgatttgttagataccaaagtacttgttcctactattatttttgtatatgaagaactggctttggatttaactgaaaacttaggaaaacaatctaatcgctgttgtctatatcattgatttaattcatcaaagttactcaaatgattgatatttttacttgctaattattttaggagtgattttgtgaaatttatttttaatacagtcctagaattgaattgaaatatggtttggaagtttgagggttttttactgtgtctatccttgtgtgtctgtttcctttaaagattcatgatacaatcactgtgtacaatgtgtcctttaatattggttcctgtaataatgtgccttcaaattatttcttgagttttgtgacttaaatatgcagttcactgactcacgccaatgttgtttgctttttaccttaattctttttactgtgctctctcagttttattttttggaagaatggtactcagtgctttgatttgattagtaagatttttgaaacacatgtaatttatttcagaaatgtgattgttttaactctgacttttttagtgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattg

SEQ ID NO: 149784 - DNA, 1920 bp, Homo sapiens
  Payload ID: 9591
  Gene Symbol: LSM8
  Gene Name: LSM8 homolog, U6 small nuclear RNA associated
  ENST ID: ENST00000422760
  CDS Start-End: 1531-1758
ggcgcgccctttcagttctgcttgctgtcggcaccgctgcgttacccggaaccgccgggccgaacagcatgacgtccgctttggagaactacatcaaccgtatcctcaagctggccgccgcgggcgtgagccggggtcgcggagaggccgcggtcggggatcggtgggaggttgggaggcctggcctcggcgggatcctgggggcgggcgaggagatgagggccccggaacgacccagagttcgccggcggcgcctcgagccttcccgctgctgcgggcccaggggtcctttccattttgcctgcaaaacccaaataaaaacccagtgtgattattccgaacttttctgtcttaaaaaaaatgtacgctcttgattcttacttactatttccctatggcataagtgttaaagtttgtgaataagatgaacagtcgtcctggcggcgacaacagttttgcaaatctttgtacttgttttattcacataatttgctcgttcgaggatagcaaaaagtttaacgatggttcacagactgtttctgtccctttaccacttgaagtcccaacttgttggtagaatgaaaaaaaatggttgctgttgtaatggattatagtgaggagcaagtaacaaccccatgggaagtcttaaaatagactttacaagtgttaccgttttaaagtcttaggacaaaaacactacgttaagctcaggtacaaactgggtgacaaaaattaaataccgaatgcttttaatgatgcgttattggtaccctgtgacactgcttatatagtttctttacttttgaattacagaagcctgtcctggaagacagttttttaacatgctggaaaatcgtccaacatcgattaatttagtactcatccacttttcattttagaaataaacaggcctaagaaacgaaatatcctgcctgaaataatagattggtaaccttcctagtagaaaagtgtcaaaaatccaggatattttgagataagatacaccgatcacatacagaaagaggttttctttttctattttttcccttttttaatcatgtaattatcacaaagacaaaaacagaagctttttttaagtttttttttttttttctttttttgagtcgagggtctcactctgttgcccaggctggagtgcagtggcttgatcatggctcaatgcaaccttgaactcctgagcccaagcaatcctcctgcctctgcctctgcctcctgagtagctgggactataggtcaccaggccagggtaatagagatgggggtatcgctgtgttgcccaagctggtctcacctcaagtgatcctcctgccttggcgtctaagaaacttttaacgtttttatgtagtgaacttagtggctgtgttgaatacttatacctagttgtcatatttattctaaaaattcaaatcattcccttgccagagtctgttttcaatttgcattccctaagaaacactttctttgattcagttatcaggaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaa

SEQ ID NO: 149785 - DNA, 290 bp, Homo sapiens
  Payload ID: 9591
  Gene Symbol: LSM8
  Gene Name: LSM8 homolog, U6 small nuclear RNA associated
  ENST ID: ENST00000411938
  CDS Start-End: 58-290
tcagttctgcttgctgtcggcaccgctgcgttacccggaaccgccgggccgaacagcatgacgtccgctttggagaactacatcaaccgtatcctcaagctggccgccgcgggcttatcaggaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgt

SEQ ID NO: 149786 - DNA, 1847 bp, Homo sapiens
  Payload ID: 9592
  Gene Symbol: LTV1
  Gene Name: LTV1 ribosome biogenesis factor
  Uniprot ID: Q96GA3
  ENST ID: ENST00000367576
  CDS Start-End: 135-1562
ttatcgccgggtcctggggctgcacgtgtggtgaggcctacagaagcggccttcagctggaccttggtctccccgccggacttcgagggtgtcatcgccgcccctgttgggggtgagcgccgcgcggctgcagcatgcctcacaggaagaaaaagccctttatagagaagaagaaagctgtgtcttttcacttggtccaccggagccaacgagatcctttagcagcagatgagagtgcaccccagagggttctattgcccacacaaaaaatagacaatgaagaaaggcgagcagaacagaggaagtatggagtgttctttgatgacgactatgactacctgcagcacctgaaggaaccatctgggccttcagagcttattccctcaagtaccttcagtgcacacaacaggagagaggagaaagaagaaacgctagtaattccaagcactggaattaagttgccttcatcagtgtttgcttcagagtttgaggaagatgttggattgttaaataaagcagctccagtttcaggacctcgactggattttgatcctgacattgttgcagctcttgatgatgattttgactttgatgatccagataatctgcttgaggatgactttattcttcaggccaataaggcaacaggagaggaagagggaatggatatacagaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagtattcgatgacttcctcagtcatgaggagaaatgaacagctgaccctacatgatgagaggtttgagaagttttatgagcaatatgatgatgatgaaattggagctctggataatgcagaattggaaggttctattcaagtggacagcaatcgcttacaggaagttttgaatgactactataaagagaaggcagagaattgtgtaaaattgaatacccttgaacccttggaggatcaagacctgccaatgaatgagcttgatgagtctgaggaggaagaaatgattactgtagtccttgaagaagccaaagagaagtgggattgtgaatctatttgtagtacatactcaaatttatataaccatccacagcttatcaagtatcaaccaaagcccaaacaaattcgaatatcttctaaaacaggaatacctctcaatgtcttaccaaagaaaggactcacagcaaagcaaactgaaagaatacagatgattaatggcagtgatcttcctaaagtatcaactcagccacgttctaaaaatgaaagcaaagaagataaaagagcaagaaagcaagctataaaagaagagcgcaaggaacgaagagtggagaagaaagctaacaaattagcatttaaactggagaaaagaaggcaagaaaaagagctgctgaacttgaagaagaatgttgagggtctaaagctatagacagtggagcatacagggcaaggcactttattaggggctcctcatctttggttattgactagaaacttcagaaagacaaaactgtttgccatttttactggcagataagaggaaaatacaatatttgtattatttttatactagtaagtgtcccctgccaaccatcttgtaaatattgtaatactttaatttttaatattataagcttacatttgctctgaagtaaatgacttcatgaatgtgaaatgtttgataaattaaaggaaaatatcttcataacgtgaa

SEQ ID NO: 149787 - DNA, 1456 bp, Homo sapiens
  Payload ID: 9593
  Gene Symbol: LUC7L
  Gene Name: LUC7-like
  Uniprot ID: Q9NQ29
  ENST ID: ENST00000293872
  CDS Start-End: 112-1227
gaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctg

SEQ ID NO: 149788 - DNA, 2097 bp, Homo sapiens
  Payload ID: 9593
  Gene Symbol: LUC7L
  Gene Name: LUC7-like
  Uniprot ID: Q9NQ29
  ENST ID: ENST00000337351
  CDS Start-End: 125-1102
tcccccgcggcgggaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctg

SEQ ID NO: 149789 - DNA, 1335 bp, Homo sapiens
  Payload ID: 9593
  Gene Symbol: LUC7L
  Gene Name: LUC7-like
  ENST ID: ENST00000397780
  CDS Start-End: 449-1267
gtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgcatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgag

SEQ ID NO: 149790 - DNA, 1504 bp, Homo sapiens
  Payload ID: 9593
  Gene Symbol: LUC7L
  Gene Name: LUC7-like
  Uniprot ID: Q9NQ29
  ENST ID: ENST00000397783
  CDS Start-End: 125-1102
tcccccgcggcgggaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgc

SEQ ID NO: 149791 - DNA, 2737 bp, Homo sapiens
  Payload ID: 9593
  Gene Symbol: LUC7L
  Gene Name: LUC7-like
  ENST ID: ENST00000426094
  CDS Start-End: 101-229
gtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggtgagtcagagcggccaaccaggcgagggtctggggtgggagtgaggcgaggccgccgggcggcctgaggcgggggccgcgatcgtctgcgcctgcgcctgcgcggggcatcgctcctcctcccccgcgctccgaccgcaggcgccgggcctttgtctaagccggtgcgtctctgaggcggccgtgggtccaggtcgggctcctctctcggagtctgcgccatggatggggcttcagcctccttcctatgtaccgtcctgctacttcctccccggcgggcgccgcggctccgtgcccctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctg

SEQ ID NO: 149792 - DNA, 989 bp, Homo sapiens
  Payload ID: 9593
  Gene Symbol: LUC7L
  Gene Name: LUC7-like
  ENST ID: ENST00000418978
  CDS Start-End: 36-203
cgtcgcggccgaccccgtcgcctccgccggctaccatgtccgcccaggcgcagatgcgggccctgctggaccagctcatgggcacggctcgggacggttcagtgtatctttgcctgcctacatcaatctgcaagggagttgcagaaagcctcatgttcatcgagccgagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgtgaaaggggggaccctaccctcagaacatgagggaataatatttacgtggctcacaaagaccagcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccggg

SEQ ID NO: 149793 - DNA, 695 bp, Homo sapiens
  Payload ID: 9593
  Gene Symbol: LUC7L
  Gene Name: LUC7-like
  ENST ID: ENST00000430864
  CDS Start-End: 148-695
gcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggag

SEQ ID NO: 149794 - DNA, 423 bp, Homo sapiens
  Payload ID: 9593
  Gene Symbol: LUC7L
  Gene Name: LUC7-like
  ENST ID: ENST00000442701
  CDS Start-End: 1-181
tcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactca

SEQ ID NO: 149795 - DNA, 498 bp, Homo sapiens
  Payload ID: 9593
  Gene Symbol: LUC7L
  Gene Name: LUC7-like
  ENST ID: ENST00000428363
  CDS Start-End: 403-498
gccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgttcagtgtatctttgcctgcctacatcaatctgcaagggagttgcagaaagcctcatgttcatcgagccgagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagat

SEQ ID NO: 149796 - DNA, 721 bp, Homo sapiens
  Payload ID: 9593
  Gene Symbol: LUC7L
  Gene Name: LUC7-like
  ENST ID: ENST00000429378
  CDS Start-End: 1-513
ctaggggctgaaggtaatgtggatgaatcccagaagattcttatggaagtggaaaaagttcgtgcgaagaaaaaagaagctgagaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 149797 - DNA, 833 bp, Homo sapiens
  Payload ID: 9593
  Gene Symbol: LUC7L
  Gene Name: LUC7-like
  ENST ID: ENST00000443357
  CDS Start-End: 582-833
tttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgcatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgtgaaaggggggaccctaccctcagaacatgagggaataatatttacgtggctcacaaagaccagcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgag

SEQ ID NO: 149798 - DNA, 1211 bp, Homo sapiens
  Payload ID: 9593
  Gene Symbol: LUC7L
  Gene Name: LUC7-like
  ENST ID: ENST00000419516
  CDS Start-End: 96-263
ctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggttcagtgtatctttgcctgcctacatcaatctgcaagggagttgcagaaagcctcatgttcatcgagccgagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgag

SEQ ID NO: 149799 - DNA, 1520 bp, Homo sapiens
  Payload ID: 9593
  Gene Symbol: LUC7L
  Gene Name: LUC7-like
  ENST ID: ENST00000629543
  CDS Start-End: 112-279
gaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggttcagtgtatctttgcctgcctacatcaatctgcaagggagttgcagaaagcctcatgttcatcgagccgagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggttt

SEQ ID NO: 149800 - DNA, 2287 bp, Homo sapiens
  Payload ID: 9594
  Gene Symbol: LUC7L2
  Gene Name: LUC7-like 2 pre-mRNA splicing factor
  ENST ID: ENST00000263545
  CDS Start-End: 1-1170
atggtcatccactcacagcttaaaaaaatacagggagcatcggagagaatgggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaacat

SEQ ID NO: 149801 - DNA, 2645 bp, Homo sapiens
  Payload ID: 9594
  Gene Symbol: LUC7L2
  Gene Name: LUC7-like 2 pre-mRNA splicing factor
  Uniprot ID: Q9Y383
  ENST ID: ENST00000354926
  CDS Start-End: 355-1533
gacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaacc

SEQ ID NO: 149802 - DNA, 2411 bp, Homo sapiens
  Payload ID: 9594
  Gene Symbol: LUC7L2
  Gene Name: LUC7-like 2 pre-mRNA splicing factor
  ENST ID: ENST00000456182
  CDS Start-End: 351-602
gtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggttcaatgtatctatgcctgcctacctcaatctgcaagggagtgtcagaaaggccccgcattcgccaagccgagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatca

SEQ ID NO: 149803 - DNA, 1525 bp, Homo sapiens
  Payload ID: 9594
  Gene Symbol: LUC7L2
  Gene Name: LUC7-like 2 pre-mRNA splicing factor
  ENST ID: ENST00000541170
  CDS Start-End: 185-1354
caatttgcccagcgcgctgtgctccgcgacggcgcatgcccgcttttgcgcaggcgcggggactacggcgcaggcgcggagactattgcgcaggcaagcgcgtacgcagaagcgtgcgcgcgcccgttcaacgtccggagcatcggtgcagtttcgaggccttcacagttgttgatcacatagcatggtcatccactcacagcttaaaaaaatacagggagcatcggagagaatgggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcct

SEQ ID NO: 149804 - DNA, 551 bp, Homo sapiens
  Payload ID: 9594
  Gene Symbol: LUC7L2
  Gene Name: LUC7-like 2 pre-mRNA splicing factor
  ENST ID: ENST00000608368
  CDS Start-End: 224-388
agacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatcccaaaagggcccggtctgcgccccacccccgcccgtccgcccgctacgccgccgccatgtcggcgcaggcccagatgcgcgcgatgctggaccagttgatgggcacctcccgggacggttcaatgtatctatgcctgcctacctcaatctgcaagggagtgtcagaaaggccccgcattcgccaagcccaaaagggagacacttcagctggaacaaaatagtggaagaaatggcgtctggggttcagtggggattcgcagtgtgagatacaactcgtcaacgaatcaaattcagtgatgacagagtatgcaagagtcaccttctcaactgttgtcctcatgatgtcctttctggaactagaatggatcttggagaatgtctgaa

SEQ ID NO: 149805 - DNA, 2783 bp, Homo sapiens
  Payload ID: 9594
  Gene Symbol: LUC7L2
  Gene Name: LUC7-like 2 pre-mRNA splicing factor
  ENST ID: ENST00000619796
  CDS Start-End: 491-1666
agttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggttcaatgtatctatgcctgcctacctcaatctgcaagggagtgtcagaaaggccccgcattcgccaagccgagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaacat

SEQ ID NO: 149806 - DNA, 1972 bp, Homo sapiens
  Payload ID: 9595
  Gene Symbol: LUC7L3
  Gene Name: LUC7-like 3 pre-mRNA splicing factor
  Uniprot ID: O95232
  ENST ID: ENST00000240304
  CDS Start-End: 131-1429
gtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctg

SEQ ID NO: 149807 - DNA, 2284 bp, Homo sapiens
  Payload ID: 9595
  Gene Symbol: LUC7L3
  Gene Name: LUC7-like 3 pre-mRNA splicing factor
  ENST ID: ENST00000393227
  CDS Start-End: 135-1604
ttttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatatta

SEQ ID NO: 149808 - DNA, 658 bp, Homo sapiens
  Payload ID: 9595
  Gene Symbol: LUC7L3
  Gene Name: LUC7-like 3 pre-mRNA splicing factor
  ENST ID: ENST00000505619
  CDS Start-End: 105-658
ggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagctcgacagggttttgccatattggccaggctggtcttgaactcctgacctcaagtgatcggtccgcctcagtctcccaaagtgctgaggttacaggcgtgagccactgcgcccggctggcatttcctaccttactccatagtaaaatagtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaat

SEQ ID NO: 149809 - DNA, 1597 bp, Homo sapiens
  Payload ID: 9595
  Gene Symbol: LUC7L3
  Gene Name: LUC7-like 3 pre-mRNA splicing factor
  ENST ID: ENST00000508482
  CDS Start-End: 105-269
ggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttt

SEQ ID NO: 149810 - DNA, 510 bp, Homo sapiens
  Payload ID: 9595
  Gene Symbol: LUC7L3
  Gene Name: LUC7-like 3 pre-mRNA splicing factor
  ENST ID: ENST00000507200
  CDS Start-End: 1-120
cgcagcaacgtgcggtgggaccacgagagcgtttgtaaatattatctctgtggtttttgtcctgcggaattgttcacaaatacacgttctgatcttgaagaaaagaggattcttctctagagaaagtgaacagttcctgagaagtgatctctgcaggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggt

SEQ ID NO: 149811 - DNA, 840 bp, Homo sapiens
  Payload ID: 9595
  Gene Symbol: LUC7L3
  Gene Name: LUC7-like 3 pre-mRNA splicing factor
  ENST ID: ENST00000504563
  CDS Start-End: 135-374
ttttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactg

SEQ ID NO: 149812 - DNA, 1112 bp, Homo sapiens
  Payload ID: 9595
  Gene Symbol: LUC7L3
  Gene Name: LUC7-like 3 pre-mRNA splicing factor
  ENST ID: ENST00000508045
  CDS Start-End: 164-403
atgctgggaaggcgtccgcgcggcggccattttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggcagaagaaaagaggattcttctctagagaaagtgaacagttcctgagaagtgatctctgcaggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaa

SEQ ID NO: 149813 - DNA, 7040 bp, Homo sapiens
  Payload ID: 9595
  Gene Symbol: LUC7L3
  Gene Name: LUC7-like 3 pre-mRNA splicing factor
  Uniprot ID: O95232
  ENST ID: ENST00000505658
  CDS Start-End: 190-1488
ctgggcgtgtcccacgggcgcacggcatgctgggaaggcgtccgcgcggcggccattttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggtggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgccatgcagaccaaaaagttattagttggtgaatatgtattttctctttggaaggtctttaaggggagcaaaccagttttaatcaatcagattgcttggtaagtttggaatctgcaatcagttggtcttaaaaaaaaaaaaactttattttggaaatttaaagacatacacaaaagaggaacaatataattaacctctgttaactcatcaccaacaagactcatgaccacttttatacttcatgagtgattgtatttgtatccactgttttctattattttcgagcaagtctcagacacaccatttaatctgtaaataattcagcatgtatctctaaaagacaaagacctcttaaataacagttcattagtataaaacaaattgggtaaacttttgttggtcatcaaactatattagcactggtccaatagtttaattttcattgagcctttcaagaggaccgaccagtctgctgctcaagacatcctctcctctggaatgtagagataatacatatcatgctcctttttgttaaaacgtttttttttccccttcaaacacagtccattcatttttcagtttgggttgaaacatccttttcttgatcttgagcttataataacctagtcatattgctcagctcagatatttttactccctctccttaggcattctggttccttaaatatagttagtgtcacagaggataaataaccaaccttatttctaaggtctgagaacacttggaccacatattggttgagctcagccaccttctgattaaagttttcagacttgtaagaactgaaaatttttatggtggaagttctctgagccctcatccattctgtttttaaaaatgcattgcagatgggctatgtgaatatgtttttaaacatctgatatgtgcatgaaacaaaaaacacttgaagttattatgtatacaattctgtgggatgggacttcatgcaggattggttttcaagtttgatttcctgagggattttttagttgtttgtgaaagaaccccaggtctacttttgaaattttgtattataattgtaatgttgcccatggttaaaaaaaaaaagtgttcagtgatctatgtctcctactactcctatttctctgtttttcctctgcaggagcttgctgctgttaacagttattcttccaagttgttttctttgtggggagatgggaggtgggaggaaatataaacatatatgtatagatctttcaaaatatatgacggtatacccgtatgttctgagtcttgctgtttttacctggtaatatttagaaacatttattttgagataaaggagagcacttttaagttgaacctgtagttttaaaaagtacatttcaagtaagccaaagcagagaagtaaatgtatttttcattgttgtatcagaattttgaatttactattttaaaaattcaagagttttgtagctgatctatttcttcccctcagccatcccaaataggtcatttgtcaacagatttaagaatgtttagaaacaacaactttgggaaacgggaaacaatttggtataagtgggtgtgccataacctctctcgtagccattcattcccggatacataccctagagaaactcttacacatgcgtaccaggggatggatttaagcatttgtgtgtaataggaagaaaagaagaaaaaacccgggaagatcccaagtgtccaccaacagtgtgttggataaatactgtggtatattccaacagtggaattccacagaagtgaaactgaactgcagctgtgtatgtgaacatggacaaaactcaacaatagaaggatcaaaaaaagcaagtcacagaagaatacatcactatggttccatttcaatgaaagtcaaaaacaggctgtcaaatacatgataaaaggaaacgattaagacaaaatttaatgttagccgttttgatggagggagaggtgatcatgagggcacaggggtcttcagaagaactggtgagggtctgtttctgaagcctgtgggcatttccttttttaatctgtatgtttatgtgcttttgtatgtatgatatttcttaataaaatttaaaaagaagaatggg

SEQ ID NO: 149814 - DNA, 582 bp, Homo sapiens
  Payload ID: 9595
  Gene Symbol: LUC7L3
  Gene Name: LUC7-like 3 pre-mRNA splicing factor
  ENST ID: ENST00000509335
  CDS Start-End: 136-375
attttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggtccgtgtgaaaaaattcatgatgaaaatctacgaaaacagtatgagaagagctctcgtttcatgaaagttggctatgagagagattt

SEQ ID NO: 149815 - DNA, 505 bp, Homo sapiens
  Payload ID: 9595
  Gene Symbol: LUC7L3
  Gene Name: LUC7-like 3 pre-mRNA splicing factor
  ENST ID: ENST00000510984
  CDS Start-End: 397-505
gggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagctgagcaagcagcacttgcgaagcgcagtttcaagtgaaggatgcatctgtgatgcaaaatcatcgaccatttatttgtaatggtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaacc

SEQ ID NO: 149816 - DNA, 1071 bp, Homo sapiens
  Payload ID: 9595
  Gene Symbol: LUC7L3
  Gene Name: LUC7-like 3 pre-mRNA splicing factor
  ENST ID: ENST00000504065
  CDS Start-End: 1-624
agctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagggcagaagataagattattggactgactactagtcctctacgggacaacaagacgactcttcctcattgaagctacctgtgcaccggagaagcccataaggcacaaagggaggactttcccacaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacatt

SEQ ID NO: 149817 - DNA, 582 bp, Homo sapiens
  Payload ID: 9595
  Gene Symbol: LUC7L3
  Gene Name: LUC7-like 3 pre-mRNA splicing factor
  ENST ID: ENST00000506686
  CDS Start-End: 136-375
attttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccagaaggatacagccagatgtttttccccaggcagaagaaaagaggattcttctctagagaaagtgaacagttcctgagaagtgatctctg

SEQ ID NO: 149818 - DNA, 419 bp, Homo sapiens
  Payload ID: 9595
  Gene Symbol: LUC7L3
  Gene Name: LUC7-like 3 pre-mRNA splicing factor
  ENST ID: ENST00000513969
  CDS Start-End: 1-370
aagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagtgcagcgtaagtatgcacagatgaagatggaactaagccgagtaagaagacatacaaaagcctcttctgaaggaaaagacagtgtagtcctgcaaaacattttgaggactactgttcgaagatttttggaagaatactgagaacggcataaagtgaagatcgacatttaaaaaatgaggtgaaagaaag

SEQ ID NO: 149819 - DNA, 507 bp, Homo sapiens
  Payload ID: 9595
  Gene Symbol: LUC7L3
  Gene Name: LUC7-like 3 pre-mRNA splicing factor
  ENST ID: ENST00000511974
  CDS Start-End: 1-259
tcgatcagaaagaaaacacagatctcgaagtcgggatcgaagaagatcaaaaagccgggatcgaaagtcatataagcacaggagcaaaagtcgggacagagaacaagatagaaaatccaaggagaaagtgcagcgtaagtatgcacagatgaagatggaactaagccgagtaagaagacatacaaaagcctcttctgaaggaaaagacagtgtagtcctgcaaaacattttgagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccag

SEQ ID NO: 149820 - DNA, 647 bp, Homo sapiens
  Payload ID: 9595
  Gene Symbol: LUC7L3
  Gene Name: LUC7-like 3 pre-mRNA splicing factor
  ENST ID: ENST00000509487
  CDS Start-End: 1-324
cgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaagataagattattggactgactactagtcctctacgggacaacaagacgactcttcctcattgaagctacctgtgcaccggagaagcccataaggcacaaagggaggactttcccacaagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaa

SEQ ID NO: 149821 - DNA, 783 bp, Homo sapiens
  Payload ID: 9595
  Gene Symbol: LUC7L3
  Gene Name: LUC7-like 3 pre-mRNA splicing factor
  ENST ID: ENST00000503728
  CDS Start-End: 1-356
gatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaagtgcagcgtaagtatgcacagatgaagatggaactaagccgagtaagaagacatacaaaagcctcttctgaaggaaaagacagtgtagtcctgcaaaacattttgagcgttggtgttgtgagcggcccatgaaaagccaaattaaaaatcaaggattcagtcaaactaagcaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgc

SEQ ID NO: 149822 - DNA, 594 bp, Homo sapiens
  Payload ID: 9595
  Gene Symbol: LUC7L3
  Gene Name: LUC7-like 3 pre-mRNA splicing factor
  ENST ID: ENST00000513025
  CDS Start-End: 455-594
cgtaagagtttttaaaaatataaaaattgccctttattttgggatgtctttcccatatttgtttttgctactggggggtcagcaggtgatgattaaaaatagataaagaaaatactagtaatacgagtactgcagatttattcttttatcgaaattcaggagtctgaaaatcactaatttacctaatatgattcaacaaatgaaattcttacattggttgaaacatacatacctcaagaaatgagaaaatagttatttggcacctttctccaataaagttttaaaaccaagcaattttttaagtacctttgtttttctttactaggtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacagg

SEQ ID NO: 149823 - DNA, 408 bp, Homo sapiens
  Payload ID: 9595
  Gene Symbol: LUC7L3
  Gene Name: LUC7-like 3 pre-mRNA splicing factor
  ENST ID: ENST00000625349
  CDS Start-End: 169-408
acggcatgctgggaaggcgtccgcgcggcggccattttgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtag

SEQ ID NO: 149824 - DNA, 3008 bp, Homo sapiens
  Payload ID: 9596
  Gene Symbol: LUM
  Gene Name: lumican
  Uniprot ID: P51884
  ENST ID: ENST00000266718
  CDS Start-End: 456-1472
gagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcttgtgaaatttctgtactttgtatataaaatacataaaacaatagattagaaatcaaaagatatctctggcctgcaatattttactgatgtgaacataggattttccactaaataatttgtctacttctagcattcacttacaaagagttcttaaaaacacctataataggtacttagatttcacaacttacttagatatttgtcattattcccattcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaatactctgcatataatttataaaaataacttctgttttacctagttaacaataaaacctatgtgtggagccaaatgttatgcagacaaaggtctgctcatcccataccagtgtatatatagtcaaatatgtgtctagtacaaataaaatgtatctctaaggcataaaatgttttaacacaccacttttagtgaactctatcttatggtacagcggcctttcatcagaggatcatcattgagactgagttgactggcagatatgtgcgatggatattacattaggtacaatgtgtatttttgattttcatgagttttctacattaaggtaaattccttagagtgtgatagcagcctcagtttatttgttggtttaaacttgaaatctactttttctcgataaaactataatgtagatgaa

SEQ ID NO: 149825 - DNA, 514 bp, Homo sapiens
  Payload ID: 9597
  Gene Symbol: LHB
  Gene Name: luteinizing hormone beta polypeptide
  Uniprot ID: P01229
  ENST ID: ENST00000221421
  CDS Start-End: 1-426
atggagatgctccaggggctgctgctgttgctgctgctgagcatgggcggggcatgggcatccagggagccgcttcggccatggtgccaccccatcaatgccatcctggctgtcgagaaggagggctgcccagtgtgcatcaccgtcaacaccaccatctgtgccggctactgccccaccatgatgcgcgtgctgcaggcggtcctgccgcccctgcctcaggtggtgtgcacctaccgtgatgtgcgcttcgagtccatccggctccctggctgcccgcgtggtgtggaccccgtggtctccttccctgtggctctcagctgtcgctgtggaccctgccgccgcagcacctctgactgtgggggtcccaaagaccaccccttgacctgtgaccacccccaactctcaggcctcctcttcctctaaagaccctccccgcagccttccaagtccatcccgactcctggagccctgacaccccgatcctcccacaataaaggcttctcaatccgca

SEQ ID NO: 149826 - DNA, 480 bp, Homo sapiens
  Payload ID: 9597
  Gene Symbol: LHB
  Gene Name: luteinizing hormone beta polypeptide
  ENST ID: ENST00000391869
  CDS Start-End: 16-480
gcaccaaggatggagatgctccaggggctgctgctgttgctgctgctgagcatgggcggggcatgggcatccagggagccgcttcggccatggtgccaccccatcaatgccatcctggctgtcgagaaggagggctgcccagtgtgcatcaccgtcaacaccaccatctgtgccggctactgccccaccatgatgcgcgtgctgcaggcggtcctgccgcccctgcctcaggtggtgtgcacctaccgtgatgtgcgcttcgagtccatccggctccctggctgcccgcgtggtgtggaccccgtggtctccttccctgtggctctcagctgtcgctgtggaccctgccgccgcagcacctctgactgtgggggtcccaaagaccaccccttgacctgtgaccacccccaacaggcctcctcttcctctaaagaccctccccgcagccttccaagtccatcccgactcctggagccctga

SEQ ID NO: 149827 - DNA, 3044 bp, Homo sapiens
  Payload ID: 9598
  Gene Symbol: LHCGR
  Gene Name: luteinizing hormone/choriogonadotropin receptor
  Uniprot ID: P22888
  ENST ID: ENST00000294954
  CDS Start-End: 23-2122
gcagaagcccagttcgccggccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgaataacaaaacactttattcttccatgcttgctgagagtgaactgagtggctgggactatgaatatggtttctgcttacccaagacaccccgatgtgctcctgaaccagatgcttttaatccctgtgaagatattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaattacctgtaccagtaattttaacataaagggttggatttaggaaattatttatttttaggtacattaggcaagagacctctacctagtagaaagtgtagtctatgaccactgccacactaaaaactatttgtcattgttacatggcataaatactgaagttgagagtgtttagaaatttttatagaaattttgacacagtaattttgtttgatgaatcttttaaaaaactgaggaggtattttgcatatcttttttttcattttcgtaatttgtattgcattctataaaaatattagttcataacagatcagaaatttaaaataactggcctttttcctcaggtagtttgaaaaacacactctagagatgcactgtccaatccggtagccactagccacatgtggctaaattaaaattaaataaaatgagaaatgtagtttctcagttgcactagccacgtttcaagttctcaatggctacgtgtgactagtgcttaccatactggacagcacagacacagaatattttcatcaccacagaaagttctatctgttctattatagagacttttatctatgccctatctggattctacttatttataatttaaggtaaacatctgaaagcacatttcagcctatttgcttagtgaaacattaagctgtagactgtaaactcctcgtgagtaggaaccctgtctcagtgcattttgttttcctgcttcctacctcaagatcttggcaatggtacactacaaatgtgctgagttagaattactctgaagttatgaaacatataatgaaaacaattttttctagagcttatatttttatttgaatgaaataaaatgtttaaatatttaaaaata

SEQ ID NO: 149828 - DNA, 1477 bp, Homo sapiens
  Payload ID: 9598
  Gene Symbol: LHCGR
  Gene Name: luteinizing hormone/choriogonadotropin receptor
  ENST ID: ENST00000401907
  CDS Start-End: 60-1037
ggccgcactcagaggccgtccaagacactggcaagccgcagaagcccagttcgccggccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgaataacaaaacactttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaa

SEQ ID NO: 149829 - DNA, 1921 bp, Homo sapiens
  Payload ID: 9598
  Gene Symbol: LHCGR
  Gene Name: luteinizing hormone/choriogonadotropin receptor
  ENST ID: ENST00000403273
  CDS Start-End: 60-1049
ggccgcactcagaggccgtccaagacactggcaagccgcagaagcccagttcgccggccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgaataacaaaacactacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaa

SEQ ID NO: 149830 - DNA, 2073 bp, Homo sapiens
  Payload ID: 9598
  Gene Symbol: LHCGR
  Gene Name: luteinizing hormone/choriogonadotropin receptor
  ENST ID: ENST00000405626
  CDS Start-End: 1-2019
atgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagattattcttccatgcttgctgagagtgaactgagtggctgggactatgaatatggtttctgcttacccaagacaccccgatgtgctcctgaaccagatgcttttaatccctgtgaagatattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaat

SEQ ID NO: 149831 - DNA, 2174 bp, Homo sapiens
  Payload ID: 9598
  Gene Symbol: LHCGR
  Gene Name: luteinizing hormone/choriogonadotropin receptor
  ENST ID: ENST00000428232
  CDS Start-End: 1-528
aactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcccatggcaaaattgtgatgaggcaataaaggagctcacccttaaagaaaaaagagaaaacatggattggaatgactctgaaatgaagagatagatgtgaagcaaaagaagagatcatctcagaggactctcttttatatcactggattctaaaaattggtatccttggtgcactgcctttgtatagtacttttactttgtgtagatgtaattttacatgtataattgtcatgttacaaagctgtgaccatgtagcttcatctcagattaatgcaatcaaaagaatacagagcagcaaccaaaaataatttcaaaaataacccatactctttacttgcaactctcaaacaccaggaaagagattctgttgatcctagaaatatttctcaacagtctctccactcctgccacttccctcacacaccacagctctaccggctgcttataaagtgttttcaactcaccattgcataatggatctggaactactcattcatcatgtcccccaccaaaaacaaggtattcaacaaacaaattccgaatgaggtgatatcacatgccttaggatttggggtctccccacatgtctatatcaagaacacaaaagacacaggattagattcatgtcctcgagaagttcatagtctcaatgagggggaaaacataaaataataaaataataatacaagctagtagatattcactatgagagtgtgtggtacctagaaataagatcttagagaagtccttttgggctggggaagtcagagaggctttatggtagagctaacagatttgaattagacctcatggaatcagtaacgtttatatgggtaaatgtgaaaatagcagctaatatgtatgtagcccttattaaatacctgcactgtttttaagtactttttaagtcccatagcaaccttatgagataggaactatcaaccctacttttagatgaggagaccaaggcatcaagaggttaagtatctctatctcaggtcaagatttggtcccagacagtatggctccagagtcatgttcttaaccgttatgcggtaccacaacatacagagaaaggcagagtaaggaatccaagtgaagagatggcaggagcaaaagcatggcaggaggagaacaggatgaggctactacttgggagtaaacatgctgtttaaggaatggaaagtgagtttagataactggctgagatggagaggacactgaattgcagagacccttaagtgccaggacaaggagacaggcttggaggtaactctggaaaaagtaataaaataatctattcaatagagtaggctttattcaaagatcacaaatatccatgactcccttcaactttgatctaaatctaaaaataatcagagaccaataggtattcctccgaggtaaatgtacaatgatgggagtggagtgaagtaggaacgaaaaggcagaagacatggaggagggtgaagaagaaaaccaatgttgggataatccataggtaactatgagctcacaagactgggccaccccacgagactcaaagagtaaccaaagattccttctcacacatcatacttcagtatgtgcacagagagcttcatggttttctaatgacagggacattaacttatgttgctcatgattttaagaaaaagagtgcatgccagtagggtgtaatttccccactctgaagttaataaagattgaggctccgtctctcccagagagcctgtggga

SEQ ID NO: 149832 - DNA, 1569 bp, Homo sapiens
  Payload ID: 9599
  Gene Symbol: LYAR
  Gene Name: Ly1 antibody reactive
  Uniprot ID: Q9NX58
  ENST ID: ENST00000343470
  CDS Start-End: 242-1381
cgcgctgggtggttcagaagcgaattctgcaccgcgaagcctgagaggcaggtagctgcggcgctgggctggcggcggcgagtccacgtgctccccgcggccggttgaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttctaaa

SEQ ID NO: 149833 - DNA, 1468 bp, Homo sapiens
  Payload ID: 9599
  Gene Symbol: LYAR
  Gene Name: Ly1 antibody reactive
  Uniprot ID: Q9NX58
  ENST ID: ENST00000452476
  CDS Start-End: 144-1283
cccagaggtccgacctgggaggctggggctcagagagcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttct

SEQ ID NO: 149834 - DNA, 780 bp, Homo sapiens
  Payload ID: 9599
  Gene Symbol: LYAR
  Gene Name: Ly1 antibody reactive
  ENST ID: ENST00000513174
  CDS Start-End: 544-780
gaggtgaggggtggtggcccagaggtccgacctgggaggctggggctcagagagtgagtaggggagggacgggatttccaccgtcagcccctctgggttacgcatggaggaaggagttccattcagatctcactcctgctctggggaagtggcaggagtcctggacttagggtgaccaactcgttttagttttaaaacttaaggtccggcgtcctgggaactccctcgggcctggccaaaccaggacgattggtcaccgcccgactgggcttcaggcttgctgcatgttggagacagggctcttctctgagccttgggagatcagtccctaaagaggaggccttaggatgtagcggtccagagcacatacttaggatcagaataactactgcgtgtgaatctgggttgccactacctggatgtgggatgacctggtgcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcag

SEQ ID NO: 149835 - DNA, 599 bp, Homo sapiens
  Payload ID: 9600
  Gene Symbol: LYNX1
  Gene Name: Ly6/neurotoxin 1
  Uniprot ID: Q9BZG9
  ENST ID: ENST00000317543
  CDS Start-End: 39-332
cggccagggcgccgacagcccgacctcaccaggagaacatgcagctcggcactgggctcctgctggccgccgtcctgagcctgcagctggctgcagccgaagccatatggtgtcaccagtgcacgggcttcggagggtgctcccatggatccagatgcctgagggactccacccactgtgtcaccactgccacccgggtcctcagcaacaccgaggatttgcctctggtcaccaagatgtgccacataggctgccccgatatccccagcctgggcctgggcccctacgtatccatcgcttgctgccagaccagcctctgcaaccatgactgacggctgccctcctccaggcccccggacgctcagcccccacagcccccacagcctggcgccagggctcacagctgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaa

SEQ ID NO: 149836 - DNA, 373 bp, Homo sapiens
  Payload ID: 9600
  Gene Symbol: LYNX1
  Gene Name: Ly6/neurotoxin 1
  ENST ID: ENST00000521396
  CDS Start-End: 1-264
ctgctggccgccgtcctgagcctgcagctggctgcagccgaagccatatggtgtcaccagtgcacgggcttcggagggtgctcccatggatccagatgcctgagggactccacccactgtgtcaccactgccacccgcccccggacgctcagcccccacagcccccacagcctggcgccagggctcacagctgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattgga

SEQ ID NO: 149837 - DNA, 600 bp, Homo sapiens
  Payload ID: 9600
  Gene Symbol: LYNX1
  Gene Name: Ly6/neurotoxin 1
  ENST ID: ENST00000523332
  CDS Start-End: 65-313
agttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaagctgcagccgaagccatatggtgtcaccagtgcacgggcttcggagggtgctcccatggatccagatgcctgagggactccacccactgtgtcaccactgccacccgcccccggacgctcagcccccacagcccccacagcctggcgccagggctcacagctgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaagcta

SEQ ID NO: 149838 - DNA, 4708 bp, Homo sapiens
  Payload ID: 9600
  Gene Symbol: LYNX1
  Gene Name: Ly6/neurotoxin 1
  Uniprot ID: Q9BZG9
  ENST ID: ENST00000614491
  CDS Start-End: 388-738
ggggccggggcaggcctggggcggggcctgcggtgagctcgcgctgggcgggctgttccgggggcgggactgggctgggcctgcggtgagcatcaggcgatgcggcacgggtgctgcgggacacacagacacgcctacgattagactcaggcaggcacctaccggcgagcggccgcgggtgactcccaggcgcggcggtacctcacggtggtgaaggtcacagggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggccaccctggccctggcccccatcctcctggccaccctctggggtctcctctaaagcccccgaggcagacccactcaagaacaaagctctcgagacacactgctacaccctcgcacccagctcaccctgcctcaccctccacactccctgcgacctcctcagccatgcccagggtcaggactgtgggcaagaagacacccgacctcccccaaccaccacacgacctcacttcgaggccttgacctttcgatgctgtgtgggatcccaaaagtgtccggctttgatgggctgatcagcccctcgcctgtccagggctatttatggggaggggcccagtcaggcagggagcactgagcagatgggagctgtggccaagcccaccttctgggaagccctaggagaggcccctgcctcagtctgcccctggtgtgctggggcagggggaagacaaggaatgcccgcaggtggggtggtggggagactcttaggaggaaaggctcctccaggcctagtcacgcttcctactgaggccaggagctgccaggaccggtacgggatcagggctgtgggaggagggcctttggcaccggcccctgtgctaggaagtctgccaggcccgagttggagccaccccctgcaggggagggggcggctctgcctcagcaggccccagggcccccgaagtcacagaagctttttcgggtccagcaaggggtgtgtgtcctctcagtcaaaccccttgacgtttcccaccccctcacggggagggcaccaggcctgaagctggcaggagctagggccatgctatatttggtgggtcctggacgctgacccggccagcgctattctgggcagggagggaaaggggcagagcaggtggtcccccgagtcctggtccccaaccacagcaggacccagccgagcaaggcaaaagacgcaggactgggggatgcgcgcacaggctgggggttgggagcagcctggggccggcgcgggcctgggcgtgggaaggcggagcatgccaccctctcgtggccgtgcgggggcgggagtggggagggtggggtggggagggcggagacccagcccctcccccgcagcgggatgcgcacagtgagtgggtccctccatcaccttccacctggggatgcacccactgggagggcagggtggaagccccagctgggtgtgtggactcccagggaccccaccccaggcctgggaagcaggggtcagcccaacacgcaccaatccatccccgatgcaggtagcccagggagcacctgcccctgctgtgaatggggcattcgggggcgtgagaccttttggtgccagcggtcacgctgcacctgaggcccccacctgaccagtgctcccagctctggtgtcctgagaaacccttcaagccatcccgcatgggcaggatggtgacatatccatgtggtaggattgtcccggccccaaagtatggccctggtcaggggagcccctgctggaaattgcatctccagagctttgatgcaggacccctgggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagccctaagcctggagagcaggaccggcccggggtgtctgggaggctgccaggtgcctcccagagctcccaagggcccccacctgcaagtgccagcctcagggcagtgcccaaatgaggccctctcagctgcagccagcgatgccttgggatgcttaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcaggggcagctgagaacaaggacctgctggagctggaagtgctgtggtgttgaggggtggggtgggcagcttctcacacctgcctcctgcctccttctgtccacctttccaccaccctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgcattgtc

SEQ ID NO: 149839 - DNA, 4537 bp, Homo sapiens
  Payload ID: 9600
  Gene Symbol: LYNX1
  Gene Name: Ly6/neurotoxin 1
  Uniprot ID: Q9BZG9
  ENST ID: ENST00000621401
  CDS Start-End: 217-567
ggctgccgcgggacgcggtgaagatagcctgcggagtgtccgggctgaacacggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggccaccctggccctggcccccatcctcctggccaccctctggggtctcctctaaagcccccgaggcagacccactcaagaacaaagctctcgagacacactgctacaccctcgcacccagctcaccctgcctcaccctccacactccctgcgacctcctcagccatgcccagggtcaggactgtgggcaagaagacacccgacctcccccaaccaccacacgacctcacttcgaggccttgacctttcgatgctgtgtgggatcccaaaagtgtccggctttgatgggctgatcagcccctcgcctgtccagggctatttatggggaggggcccagtcaggcagggagcactgagcagatgggagctgtggccaagcccaccttctgggaagccctaggagaggcccctgcctcagtctgcccctggtgtgctggggcagggggaagacaaggaatgcccgcaggtggggtggtggggagactcttaggaggaaaggctcctccaggcctagtcacgcttcctactgaggccaggagctgccaggaccggtacgggatcagggctgtgggaggagggcctttggcaccggcccctgtgctaggaagtctgccaggcccgagttggagccaccccctgcaggggagggggcggctctgcctcagcaggccccagggcccccgaagtcacagaagctttttcgggtccagcaaggggtgtgtgtcctctcagtcaaaccccttgacgtttcccaccccctcacggggagggcaccaggcctgaagctggcaggagctagggccatgctatatttggtgggtcctggacgctgacccggccagcgctattctgggcagggagggaaaggggcagagcaggtggtcccccgagtcctggtccccaaccacagcaggacccagccgagcaaggcaaaagacgcaggactgggggatgcgcgcacaggctgggggttgggagcagcctggggccggcgcgggcctgggcgtgggaaggcggagcatgccaccctctcgtggccgtgcgggggcgggagtggggagggtggggtggggagggcggagacccagcccctcccccgcagcgggatgcgcacagtgagtgggtccctccatcaccttccacctggggatgcacccactgggagggcagggtggaagccccagctgggtgtgtggactcccagggaccccaccccaggcctgggaagcaggggtcagcccaacacgcaccaatccatccccgatgcaggtagcccagggagcacctgcccctgctgtgaatggggcattcgggggcgtgagaccttttggtgccagcggtcacgctgcacctgaggcccccacctgaccagtgctcccagctctggtgtcctgagaaacccttcaagccatcccgcatgggcaggatggtgacatatccatgtggtaggattgtcccggccccaaagtatggccctggtcaggggagcccctgctggaaattgcatctccagagctttgatgcaggacccctgggggatcagggaatgagggtctccaccccaggggtctccttgcagtgagtctatatgcaggcctgcgttctgctcctggggctggttctgagtgcccagcttcagtctcctgagaacatgaggatgggagggggcagagtcttgctgagggcacacccagttcccgctggaggaggacagtgccagtcttctgcaaagggaccttgggtgggaacgggcccggagcgggaggaacgtgactccccagagggaagatgggcatcatactgggcccagagctgggaaggagttgctgccagcacagggtgggcctggactcccctcgcccctacccccagtggttgtggctgtagccctaagcctggagagcaggaccggcccggggtgtctgggaggctgccaggtgcctcccagagctcccaagggcccccacctgcaagtgccagcctcagggcagtgcccaaatgaggccctctcagctgcagccagcgatgccttgggatgcttaccgggagggaggcggctttgggctcctaagtccttgggagaggctgggagcagtcactgcgcggcttgcgcaagcccattgtcgggttgggtggcttcctcagccagggctgggagggactccaggatcaggtcctccctgtctcgagtctcagtggggtgatggggaggagacctggccacccatggctcaggggcagctgagaacaaggacctgctggagctggaagtgctgtggtgttgaggggtggggtgggcagcttctcacacctgcctcctgcctccttctgtccacctttccaccaccctgacctgtcccagccccacacatggttctgcctggctggcctgcccttggcacctggcgtagagcacacagaaggcactcagctaatgctgggcaggcccactcatggggagtgcgtggctgtgcagcaccagggaaccggcacagcagcgccggcagaaatcacagcagtaaacttgtccgggttgtatgcatcaaggtggcgatggacgtgggtccccccactgcactgtggccctgagcactgtatagcagcccggcaatgggagccattatcttgcccctttgacagaggaggacacagaggcacagggaggtgaagtagctgccccacactagtgcctcctcgctcactcaccaccccctgcaccacagtgcagccgcttctcccaccagctggggttccttggacccccaagcctgggaagggggaggtgagtttacaaaatggaaagcttaaaaggagaaaagtggaaccagaggtttgagaagccctgagtggtagagtaaggcctccagcgctgcctctgggtgcagggcagagtggcagaggagagggggagaggcactgggcaccatgggggcccagttcccacttcggggatctctctcgcagaaccgagggtccccttcatgggggtagatgcccagggctagctgttgccactgtctgtgtggacctgagtcctggacatgcccgagtgactcaggagtggctgcttgggcgggctctgtcaccctaggatgttatacattctgggaactggacaggagtggctgcttgggcgggctctggcaccctgggatgttatacattctgggaactggacaggagtggctgcttgggtgggctctggcaccctgggatgttatacattctgggaactgcaatcagccactagagaagtcggagctacaggaagtgaccctggggtgggacctggggacatggccaggtcagcatggggacacccggctccagcaggagctctggtctgtcctggggtctttgggggcagggctgcggccctgggcaggcttcctccaggcggaggtcctggggaagtgggggagccaggccagctgccgcctcccccactatgtagcatctgattcgtcatctctcatgaaggcgatttggttcataactctgaaactctgaaaaaggtcaaaagaagcagagaggccctcggtggatatgccagcttttctgccggtgctttctcccactactctgggtggtctgctctcctcttcaaacctcagctcgcagggagggcctgaatctgccagcccctcaggatctccttccctctgggccctccccagccttaaggagcctcccagacagaagggtggacagagccacctgggcagcccgagagacacacgggggtcctccctgtggacagccctgccagcttccgcccagccctgagcttcatttgcatcttgaggagtaaggggtggtgaaatgggaatgctggtctggctcagctggtcgtgggcataagtgcccgctgaatggatggcatctctccctcctgtcttatgttctggggtccaggtgcttcccagggccatgcccctgctgctaatgcttgccctaacccttaccctaaccagcgtccagcgtcgtctcaccgagccgtaaataaatcaacagattcgcattgtc

SEQ ID NO: 149840 - DNA, 868 bp, Homo sapiens
  Payload ID: 9600
  Gene Symbol: LYNX1
  Gene Name: Ly6/neurotoxin 1
  Uniprot ID: Q9BZG9
  ENST ID: ENST00000620006
  CDS Start-End: 274-624
gagggggttgggaagctcgaagccgcaggcctgactctggcctttggcatcctggggttggcctgggcaaatgtgtcgtgagagacggatttgttgttctcgggaaggcggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggccaccctggccctggcccccatcctcctggccaccctctggggtctcctctaaagcccccgaggcagacccactcaagaacaaagctctcgagacacactgctacaccctcgcacccagctcaccctgcctcaccctccacactccctgcgacctcctcagccatgcccagggtcaggactgtgggcaagaagacacccgacctcccccaaccaccacacgacctcacttcgaggccttgacctttcgatgctgtgtgggatcccaaaagtgtccggctttgatgggctgatcagcc

SEQ ID NO: 149841 - DNA, 1293 bp, Homo sapiens
  Payload ID: 9600
  Gene Symbol: LYNX1
  Gene Name: Ly6/neurotoxin 1
  Uniprot ID: Q9BZG9
  ENST ID: ENST00000615007
  CDS Start-End: 631-1026
tttagggtagaagaaaaggttttatttttctttctcacattggaaaaaatgaaaactttcggacccatgaaattttattacattttgccaaaaacagaaccaataacataagtattcaaagttatgtaaagataattatttaatatgaacattatgatggtgagagggaccacggagcaaggggctgccttgcaggcctgccttccagctttgctacagggaccagaagcgggagctgagcgcaggggaggcaggcggaggccatgggcagcgaggcgggtgcgccaaagggcgccagttccggagctgctgggcctgggctgcaggagggcggagctggggccgcaaggctggtgccggccgacaaacgacgcggcgcgggcgagtgggcggaggcggctgcggggaaggctgggctgccgcgggacgcggtgaagatagcctgcggagtgtccgggctgaacacggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctctgcagccgaagccatatggtgtcaccagtgcacgggcttcggagggtgctcccatggatccagatgcctgagggactccacccactgtgtcaccactgccacccgggtcctcagcaacaccgaggatttgcctctggtcaccaagatgtgccacataggctgccccgatatccccagcctgggcctgggcccctacgtatccatcgcttgctgccagaccagcctctgcaaccatgactgacggctgccctcctccaggcccccggacgctcagcccccacagcccccacagcctggcgccagggctcacagctgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaa

SEQ ID NO: 149842 - DNA, 639 bp, Homo sapiens
  Payload ID: 9600
  Gene Symbol: LYNX1
  Gene Name: Ly6/neurotoxin 1
  ENST ID: ENST00000613110
  CDS Start-End: 388-639
ggggccggggcaggcctggggcggggcctgcggtgagctcgcgctgggcgggctgttccgggggcgggactgggctgggcctgcggtgagcatcaggcgatgcggcacgggtgctgcgggacacacagacacgcctacgattagactcaggcaggcacctaccggcgagcggccgcgggtgactcccaggcgcggcggtacctcacggtggtgaaggtcacagggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcc

SEQ ID NO: 149843 - DNA, 563 bp, Homo sapiens
  Payload ID: 9600
  Gene Symbol: LYNX1
  Gene Name: Ly6/neurotoxin 1
  ENST ID: ENST00000614268
  CDS Start-End: 318-563
gacaccccaggagcagagaggaggggaacagcgagaagagacccagcttttgggcccagtcctgccatggccagccatccggcccccagggccctgcttgggatggggctgcagaccacctcccatgggacctctgcaccaaccatcccctggggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccacc

SEQ ID NO: 149844 - DNA, 1033 bp, Homo sapiens
  Payload ID: 9601
  Gene Symbol: LYPD1
  Gene Name: LY6/PLAUR domain containing 1
  Uniprot ID: Q8N2G4
  ENST ID: ENST00000345008
  CDS Start-End: 506-775
gaaatgaaagaagggggagagggagggagggagggagagaaggagcctgaggcagatatggaacgatctctgcagaggaattacaaagaaagtcatttaagcccctttacagaccagctctgctgggaggatgcagaaataaatgatcagcgtcccggcgtgagagagctgcccccagaagtggccgggggagaaaagggtgaagaggagctaaagcttaggaggcgatttccacggaaatggatgctccctaaggatgtgcggaaaggggatgggaatgtgcggattgggggcgggggcaccaacgcactccggcgggcaagcggtctcccgcaccacctgctgcaaggctcgggaaggaaggcgaagatagcaccggggcatccccgggagtccgcaaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccgga

SEQ ID NO: 149845 - DNA, 1891 bp, Homo sapiens
  Payload ID: 9601
  Gene Symbol: LYPD1
  Gene Name: LY6/PLAUR domain containing 1
  Uniprot ID: Q8N2G4
  ENST ID: ENST00000397463
  CDS Start-End: 274-699
ccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaatgaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgt

SEQ ID NO: 149846 - DNA, 578 bp, Homo sapiens
  Payload ID: 9601
  Gene Symbol: LYPD1
  Gene Name: LY6/PLAUR domain containing 1
  ENST ID: ENST00000449209
  CDS Start-End: 269-388
agtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctc

SEQ ID NO: 149847 - DNA, 594 bp, Homo sapiens
  Payload ID: 9602
  Gene Symbol: LYPD2
  Gene Name: LY6/PLAUR domain containing 2
  Uniprot ID: Q6UXB3
  ENST ID: ENST00000359228
  CDS Start-End: 84-461
ccagtctgtcgccacctcacttggtgtctgctgtccccgccaggcaagcctggggtgagagcacagaggagtgggccgggaccatgcgggggacgcggctggcgctcctggcgctggtgctggctgcctgcggagagctggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtagagtccccgcccacccccatggccctatgcggcccagccccgaatgccttgaagaagtgccccctgcaccaggactcctgagtctcctttctgggcacagacctgccctgctgcatctctgacctcgtcgatgt

SEQ ID NO: 149848 - DNA, 1694 bp, Homo sapiens
  Payload ID: 9603
  Gene Symbol: LYPD3
  Gene Name: LY6/PLAUR domain containing 3
  Uniprot ID: O95274
  ENST ID: ENST00000244333
  CDS Start-End: 90-1130
gcgaggttactcatcctgggctcaggtaagagggcccgagctcggaggcggcacatccaggggggacgccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctgccaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtatagtg

SEQ ID NO: 149849 - DNA, 1051 bp, Homo sapiens
  Payload ID: 9604
  Gene Symbol: LYPD4
  Gene Name: LY6/PLAUR domain containing 4
  Uniprot ID: Q6UWN0
  ENST ID: ENST00000343055
  CDS Start-End: 347-982
cttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagcaccttgtccaatgggaggacctaagtgggagagtgagagtcctgctttgagaagctaagatggtggatggtgcagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgtatgtcctgtggggctggatgctataagacccagaaagggactgcaaggggagtcgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctttc

SEQ ID NO: 149850 - DNA, 1076 bp, Homo sapiens
  Payload ID: 9604
  Gene Symbol: LYPD4
  Gene Name: LY6/PLAUR domain containing 4
  Uniprot ID: Q6UWN0
  ENST ID: ENST00000601246
  CDS Start-End: 372-1007
gcccctggggcgttgaccaagcccgcttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagcaccttgtccaatgggaggacctaagtgggagagtgagagtcctgctttgagaagctaagatggtggatggtgcagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgtatgtcctgtggggctggatgctataagacccagaaagggactgcaaggggagtcgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctttc

SEQ ID NO: 149851 - DNA, 2026 bp, Homo sapiens
  Payload ID: 9604
  Gene Symbol: LYPD4
  Gene Name: LY6/PLAUR domain containing 4
  Uniprot ID: Q6UWN0
  ENST ID: ENST00000609812
  CDS Start-End: 1217-1957
ggtctgtgcacgggttgcctcgtttctggccttcccttgccttgtacctcgacttcgcgcgtggcttgtttttgctgagtggaggcctgcgttttctgttatgtctcttccggtgccccacaactcctgagctacccttcttttatgcgttctctcccagcgctgtgattaccgggttgcttaccgggccctccttcctcagattgcacccctttccttgtgtctcttcttgtctttgtgtcggttgtgattttcctaatctctgattttccttttctctcggacgctctccctcttcggacccattttctcccgtgcttcatgccctgatagcctggccccttcccggcttccttcgctaccggggacgcctctagtttttctgaatttctggctggctccaccctccgcgttcatcttcctcaagagttcgcccctctgggggctcctctgtgtaatcgtcgccttctctgggtatttctgtgaactccgtctcacaccatcccgccatcttctctgccttggccccttttctctgtacagccagctctgtgtccttttcttctccccctctaaaatcgactcctcttctccctgagagccccacctttgtgccccactcctcattttcctacgcctccctctctctgctggtcctctctctccctgcaaggttccattccatcaatttgtttgtcttttgtaggggtggcatcccctctgactactgctccatcctttttttttttttttttttttttttttttgcttgaggatttcacttcaatcttttctggttgcgtctccacttgtactcagcttgttaggtccaggtccagttgttctgcatctgaggctggcgtgtgctgtcttctctgattggcctaatctccctcacccccgtgagatctgttgtcagccttcgtttctctttcctgtgtcccagcttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgggctggagctcttttgtgctatgaagcaacagcctcaagattcagagctgttgctttccataactggaagtggcttctgatgaggaacatggtgtgtaagctgcaagagggctgcgaggagacgctagtgttcattgagacagggactgcaaggggagtcgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctttc

SEQ ID NO: 149852 - DNA, 2499 bp, Homo sapiens
  Payload ID: 9605
  Gene Symbol: LYPD5
  Gene Name: LY6/PLAUR domain containing 5
  Uniprot ID: Q6UWN5
  ENST ID: ENST00000377950
  CDS Start-End: 82-837
gatgcttaggactcagtaaggagaaccagccaggcagcacatcacagcgggaggagctgtcccaggtggcccagctcagcaatggcaatgggggtccccagagtcattctgctctgcctctttggggctgcgctctgcctgacagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacgcggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatccccggggagggcaaaacagccatgtcgtgccccgatgaagagcaattctgatcacagctgttactcactgagcaccagccaggcaccaggcaccccataacacggcttcctgtgctctccctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggagcacaaggagtgcaggacactttcatgagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagc

SEQ ID NO: 149853 - DNA, 2137 bp, Homo sapiens
  Payload ID: 9605
  Gene Symbol: LYPD5
  Gene Name: LY6/PLAUR domain containing 5
  Uniprot ID: Q6UWN5
  ENST ID: ENST00000414615
  CDS Start-End: 161-787
gattcttgggttccgcgtgtagtttcggaaggagacatcgaagcagggcgaggcgcagagggcgttgcggactcatgccccagtcggcagtgcggggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacgcggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatccccggggagggcaaaacagccatgtcgtgccccgatgaagagcaattctgatcacagctgttactcactgagcaccagccaggcaccaggcaccccataacacggcttcctgtgctctccctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggagcacaaggagtgcaggacactttcatgagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctg

SEQ ID NO: 149854 - DNA, 569 bp, Homo sapiens
  Payload ID: 9605
  Gene Symbol: LYPD5
  Gene Name: LY6/PLAUR domain containing 5
  ENST ID: ENST00000594049
  CDS Start-End: 187-569
atcgaagcagggcgaggcgcagagggcgttgcggactcatgccccagtcggcagtgcgggtaagggtgggagaagcaatgaggcgaatgcgagcagccgaagaaggcgacagtgtggctggggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacgcggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgac

SEQ ID NO: 149855 - DNA, 1519 bp, Homo sapiens
  Payload ID: 9605
  Gene Symbol: LYPD5
  Gene Name: LY6/PLAUR domain containing 5
  Uniprot ID: Q6UWN5
  ENST ID: ENST00000594013
  CDS Start-End: 261-887
agagaggtcattactctgccatgagacagacacagctgtgaccagctgcaatagcagcacctggtctctcaaggcgtgtcttccctgggagcagaggggccaggcccgtgtgcctgtcatttgctgggtggagctctgagttcctgggacaggctcacactggccctgctgactctgccacgcctctctccccagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacgcggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatccccggggagggcaaaacagccatgtcgtgccccgatgaagagcaattctgatcacagctgttactcactgagcaccagccaggcaccaggcaccccataacacggcttcctgtgctctccctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccatt

SEQ ID NO: 149856 - DNA, 607 bp, Homo sapiens
  Payload ID: 9605
  Gene Symbol: LYPD5
  Gene Name: LY6/PLAUR domain containing 5
  ENST ID: ENST00000602179
  CDS Start-End: 267-607
aacttggcttcacctgtcaaaggcgcttttttcgaagacgcccgggagctcttgcttttgcttgagggtctttggtgttgactgagagcgaattaaaaggttctcagctttcgctaaggaacgcattctggagtctagaacaggcgaagatgggactggggtgtctggggacttagacgtgagcgagcaagggaatccgggggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacgcggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtca

SEQ ID NO: 149857 - DNA, 4071 bp, Homo sapiens
  Payload ID: 9606
  Gene Symbol: LYPD6
  Gene Name: LY6/PLAUR domain containing 6
  Uniprot ID: Q86Y78
  ENST ID: ENST00000334166
  CDS Start-End: 258-773
gagtggcgcgcgcgcccctagccgccccccgcctctccccgctgcgctccctcgctccttccctgagctcccgggctccggcagcgggctggcggggcgccgcattgcacactctgggggcgccgcagtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagatgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtagagggatcaggtccacagtggtgcagattcaaccaccacccagggagtgcttgcagactctgcatagatgttgctgcatgtgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcaatattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgtatcttaccaggctcctccctgcaaatgcacatgtcaatcaatgattaatgcacccaggttatgtacaaggcactgggcttagcaccacagggaacttccttccagaggcttgctttctagttgtgtagacaagaatacatgcatgagaagatacaagacaattcacccatgccaaatgattcatacaggctgtttaagtactgcagaaaataaaagaaggaaaggctaccagacttttcaataaggtctacagcttcccaagagcatgtctttgttaaatcaggaaatataaaaattatgtgtgtatgtgtatgtatatatatataccaccctattaactattttaaaatcgtattctattttgggggttgtgttaatgatgatgaaccagaaaagattttctcttgatggtttcttcaacaggaaacagatattggaatagtgtacatgtcatttttatctatacaatgaatttattatatttttcttagtaaagtgatagacattgaaagcaagcttgaaaaa

SEQ ID NO: 149858 - DNA, 1580 bp, Homo sapiens
  Payload ID: 9606
  Gene Symbol: LYPD6
  Gene Name: LY6/PLAUR domain containing 6
  Uniprot ID: Q86Y78
  ENST ID: ENST00000392854
  CDS Start-End: 493-723
gggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcagggtgagcaacaaggcactattttggaagcagagaacagccctcaccagacacggaatctgctggtgccctgatcttggaattcccaccgtctagaactgtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgaggaaccatgatctagaagaaaagccagatatcccaaatgagaaagttaagaaggactaagacaacatggagaagagagaagattagcattgacctggttgggaggaagatcaggaagatttcacagaatttatcacatttggattgagccttgaagaatatcaggtgtccaggagtagaagataggaaaaaatatgcagaccatgctaaggatgcacatttttcatcgtgcatggtcaaaagttgtggtactatgtctcaaggtatatacgaggcaatgaggagacagtttggagcctccatcaaggagaaccagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaa

SEQ ID NO: 149859 - DNA, 3578 bp, Homo sapiens
  Payload ID: 9606
  Gene Symbol: LYPD6
  Gene Name: LY6/PLAUR domain containing 6
  Uniprot ID: Q86Y78
  ENST ID: ENST00000409381
  CDS Start-End: 290-805
actgcaaacgtcaagtggtctccgccttccctgggttcggagcttcacttgctcttgagctctgcggtccggcggatttcgcggggcccaggggatggcggggagtgagatttggccagggtcatttcacactgccgggcctgcagccacgcacgcagctgctggcccggctgaggctggcggctagggagaggcgccagggggtcgcgcacaggaaggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagatgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtagagggatcaggtccacagtggtgcagattcaaccaccacccagggagtgcttgcagactctgcatagatgttgctgcatgtgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcaatattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgt

SEQ ID NO: 149860 - DNA, 565 bp, Homo sapiens
  Payload ID: 9606
  Gene Symbol: LYPD6
  Gene Name: LY6/PLAUR domain containing 6
  ENST ID: ENST00000414420
  CDS Start-End: 406-565
agcactgtgcagggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcaggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaa

SEQ ID NO: 149861 - DNA, 1204 bp, Homo sapiens
  Payload ID: 9606
  Gene Symbol: LYPD6
  Gene Name: LY6/PLAUR domain containing 6
  Uniprot ID: Q86Y78
  ENST ID: ENST00000418762
  CDS Start-End: 132-362
agtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgaggaaccatgatctagaagaaaagccagatatcccaaatgagaaagttaagaaggactaagacaacatggagaagagagaagattagcattgacctggttgggaggaagatcaggaagatttcacagaatttatcacatttggattgagccttgaagaatatcaggtgtccaggagtagaagataggaaaaaatatgcagaccatgctaaggatgcacatttttcatcgtgcatggtcaaaagttgtggtactatgtctcaaggtatatacgaggcaatgaggagacagtttggagcctccatcaaggagaaccagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttg

SEQ ID NO: 149862 - DNA, 1100 bp, Homo sapiens
  Payload ID: 9607
  Gene Symbol: LYPD6B
  Gene Name: LY6/PLAUR domain containing 6B
  ENST ID: ENST00000280115
  CDS Start-End: 1-552
atgcgatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatg

SEQ ID NO: 149863 - DNA, 1248 bp, Homo sapiens
  Payload ID: 9607
  Gene Symbol: LYPD6B
  Gene Name: LY6/PLAUR domain containing 6B
  Uniprot ID: Q8NI32
  ENST ID: ENST00000409876
  CDS Start-End: 151-702
cgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaa

SEQ ID NO: 149864 - DNA, 1306 bp, Homo sapiens
  Payload ID: 9607
  Gene Symbol: LYPD6B
  Gene Name: LY6/PLAUR domain containing 6B
  Uniprot ID: Q8NI32
  ENST ID: ENST00000409029
  CDS Start-End: 203-754
ctctgctggagcaggacttcagagtgtttgttttcagcctgcttttaaagtgatttgaagagagtggctttgaagattatcgcggaacacctgcccattaatcttgaccctgttaaaacaataactgcctatccagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaa

SEQ ID NO: 149865 - DNA, 1577 bp, Homo sapiens
  Payload ID: 9607
  Gene Symbol: LYPD6B
  Gene Name: LY6/PLAUR domain containing 6B
  Uniprot ID: Q8NI32
  ENST ID: ENST00000409642
  CDS Start-End: 402-1025
acttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcagggaggagccgcgccccgccccgcgcggtagcagccaacgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttgctgattactctgagtgcaaaccttttcactgttccagagaggagcctgacaaccacattctccttctcaagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaa

SEQ ID NO: 149866 - DNA, 528 bp, Homo sapiens
  Payload ID: 9607
  Gene Symbol: LYPD6B
  Gene Name: LY6/PLAUR domain containing 6B
  ENST ID: ENST00000437627
  CDS Start-End: 213-365
gtgctggggctggggcggctacatagctgtgactaccagggggtgcagtctctggggaccaccactaccgaggctgggtaccatgattatcgcggaacacctgcccattaatcttgaccctgttaaaacaataactgcctatccagatatgccacacttctgcctgctgttggcaaccctcctggactaggctgctcttgttaatcacatggatgttatgtgaaaggcattgtacagaagaagatgagaatcacagtaaaccaaacaaaggaaatgcagaagagatattttcagctgaatattggaaagtaagattccctgcgagcaggatctcaggcaacgtcaatgaacaacatgaagcctgacacattctaattagtctaaggaaaatggtgacagaggatatattccgtaacgtctcaggaggtcgcctggctccagagagtgtaaaatgccacacgttggatgagatgattatccgagctcagacttgggaaatagtcatgcttctggaccaagtgccaggta

SEQ ID NO: 149867 - DNA, 515 bp, Homo sapiens
  Payload ID: 9607
  Gene Symbol: LYPD6B
  Gene Name: LY6/PLAUR domain containing 6B
  ENST ID: ENST00000442722
  CDS Start-End: 128-292
attatcgcggaacacctgcccattaatcttgaccctgttaaaacaataactgcctatccagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccacaagtaaaacgtctttgatatactttattagagagtgattcttataaataaaaaattatttggtatacatgtgggtacctgtagttcccacgcctggaagagtatcagaatcatgatgaaaggatttttaactgcatatccctaatcacttctccagagatttaacagtcaagaggctacaccatttccaaatagcttcaagtgctttacttgtgaaaacgcaggggata

SEQ ID NO: 149868 - DNA, 484 bp, Homo sapiens
  Payload ID: 9607
  Gene Symbol: LYPD6B
  Gene Name: LY6/PLAUR domain containing 6B
  ENST ID: ENST00000450639
  CDS Start-End: 198-422
cggctacatagctgtgactaccagggggtgcagtctctggggaccaccactaccgaggctgggtaccatgattatcgcggaacacctgcccattaatcttgaccctgttaaaacaataactgcctatccagatatgccacacttctgcctgctgttggcaaccctcctggactaggctgctcttgttaatcacatggatgttgctgattactctgagtgcaaaccttttcactgttccagagaggagcctgacaaccacattctccttctcaagatgtgaaaggcattgtacagaagaagatgagaatcacagtaaaccaaacaaaggaaatgcagaagagatattttcagctgaatattggaaagtaagattccctgcgagcaggatctcaggcaacgtcaatgaacaacatgaagcctgacacattgtaggtgccccgtaaatattggttgagtaactgaataaacgtatttagtaacttaa

SEQ ID NO: 149869 - DNA, 1233 bp, Homo sapiens
  Payload ID: 9608
  Gene Symbol: LYPD8
  Gene Name: LY6/PLAUR domain containing 8
  ENST ID: ENST00000566597
  CDS Start-End: 1-164
accctcccctgaagaacgtgtccagcaacgcagagtgccctgcttgttatgaatctaatggaacttcctgtcatgggaagccctggaaatgctatgaagaagaacagtgtgtctttctagttgcagaacttaagaatggaacaccaggtgatggtgcagattgagctgtagactcacctagacaaatacccccttggggttcacttcctacccaagaagctggatgaggcagtggctgaagtccacctgcacaggctaaatgtgaagttgaccaagctgactgagaagcaggcccagtacctgggcatgtcctgtgatggccccttcaaactggatgactaccactactgagaaccaggcctgcccttcacctaccagctgctgtccttgccctggccctgcctcccctaagagcaaatgacaccaactttgtgattgttttcagtgtcccccattgactccctggggctggtcacttaggttttggcctctactgcatccctcatactgttgcaagtgtggcagggggaattgaaaagccccccccccctcaagctctggtcatgatgaaggtacaagggagacatccacagggaaccatgagctcagtggtcttggaattgctcactaagtcagtccttccttagcctggaagttggtcatggagtcacaaagcccatgtactttaccatctaggccttcacctggtctgtggacttacacccgtgtgcttggtttactggttcagtagttcctcagaccatgacaaatggaaggagctatactgaagaacaatgaggaactctttgaattttcctgagcacgtgacttactgctgggccttcccttaaacatcagaacaatgagatttgtccctattttacaggggttagaatagactattaagggacaactgagaaaggacagagaagtgacagccagaggttgagaggggccataaaaacatacaatcagacatatatctgctaccactttgtagcaagatggttcctatcataactctgggtcaaaaagatagtaatttggtttataatgttgaaagaaagcagaaagagatggggtctcactgtcgttctggagtgtagtggttcaatcatctctcactgcagccttgaacccctaggctcaaaggatcctcccacctcagcctcctgaatagctgggactagaggcatgagccactatgtcttgctgattaaaaattgtttttgc

SEQ ID NO: 149870 - DNA, 1142 bp, Homo sapiens
  Payload ID: 9608
  Gene Symbol: LYPD8
  Gene Name: LY6/PLAUR domain containing 8
  ENST ID: ENST00000590317
  CDS Start-End: 233-946
cttctgtaggacagtcaccaggccagatccagaagcctctctaggctccagctttctctgtggaagatgacagcaattatagcaggaccctgccaggctgtcgaaaagattccgcaataaaactttgccagtgggaagtacctagtgaaacggcctaagatgccacttcttctcatgtcccaggcttgaggccctgtggtccccatccttgggagaagtcagctccagcaccatgaagggcatcctcgttgctggtatcactgcagtgcttgttgcagctgtagaatctctgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgctcagcggagaactgcagtgaggagacacacattacagccttcactgtccacgtgtctgctgaagaacactttcattttgtaagccagtgctgccaaggaaaggaatgcagcaacaccagcgatgccctggaccctcccctgaagaacgtgtccagcaacgcagagtgccctgcttgttatgaatctaatggaacttcctgtcatgggaagccctggaaatgctatgaagaagaacagtgtgtctttctagttgcagaacttaagaatgacattgagtctaagagtctcgtgctgaaaggctgttccaacgtcagtaacgccacctgtcagttcctgtctggtgaaaacaagactcttggaggagtcatctttcgaaagtttgagtgtgcaaatgtaaacagcttaacccccacgtctgcaccaaccacttcccacaacgtgggctccaaagcttccctctacctcttggcccttgccagcctccttcttcggggactgctgccctgaggtcctggggctgcactttgcccagcaccccatttctgcttctctgaggtccagagcaccccctgcggtgctgacaccctctttccctgctctgccccgtttaactgcccagtaagtgggagtcacaggtctccaggcaatgccgacagctgccttgttcttcattattaaagcactggttcattcactgcccaaa

SEQ ID NO: 149871 - DNA, 5482 bp, Homo sapiens
  Payload ID: 9609
  Gene Symbol: LY75-CD302
  Gene Name: LY75-CD302 readthrough
  ENST ID: ENST00000505052
  CDS Start-End: 29-5482
ccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaa

SEQ ID NO: 149872 - DNA, 5650 bp, Homo sapiens
  Payload ID: 9609
  Gene Symbol: LY75-CD302
  Gene Name: LY75-CD302 readthrough
  ENST ID: ENST00000504764
  CDS Start-End: 29-5650
ccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaa

SEQ ID NO: 149873 - DNA, 3273 bp, Homo sapiens
  Payload ID: 9610
  Gene Symbol: LYVE1
  Gene Name: lymphatic vessel endothelial hyaluronan receptor 1
  Uniprot ID: Q9Y5Y7
  ENST ID: ENST00000256178
  CDS Start-End: 160-1128
agcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcagctatggctgggttggagatggattcgtggtcatctctaggattagcccaaaccccaagtgtgggaaaaatggggtgggtgtcctgatttggaaggttccagtgagccgacagtttgcagcctattgttacaactcatctgatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttagaaaacttctttgctttcttatttacgtagatgcattatacctttcatgtaaaattaaagtgaggaccagatcatatcatattgtttgcaaaaataaaagggacaatgttggttgttaaaatacaagcatatgtcaaccaaacagcatatatcatatggggctattcatgctccaaacattttattttgagttggccaagtacatacacattaaacagtcctttactagagatgctggccctccatttccatccatttcagaattcaccagggagccagagatccaggatggctcattcgtctcacttttgaccgccctgcttctctagttttctctttccctcccgcttagactgctaattgtcttcttcccctcaccagtgaccccacagctccgtggttccttcggcccagatgccacaacctgctggcataatcttttccggttggcccacggagtataatcttaaaatttgatttcatttccaggcattaaaaatcaagagatttcacatggttacatttctgggttccctctaaaaatggaaagatctggaagtaaagaacccatgttccctcatagcaatcattatctgatactgagtagcagctgtcccctttcaatggggtctgctctttttgtttcaccacagtcctcatgactctctgttgcacactcatgccaaagtaaaggtgccctttcctatgaactttgtaacactgtggccttttcttcacacccagcccacgtccctcatatatatcacctgcctgccccagtaggtctatgagtttgaaactggtttgtcagtccttaagctttatcagcttcatccatttctcagggagtaaagaagaaaagagggaaagcgcctaagtagtgatcttccctctgtgtgttagctgaaa

SEQ ID NO: 149874 - DNA, 1823 bp, Homo sapiens
  Payload ID: 9610
  Gene Symbol: LYVE1
  Gene Name: lymphatic vessel endothelial hyaluronan receptor 1
  ENST ID: ENST00000438354
  CDS Start-End: 187-402
gtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaaggtagttcttttttagctctgtgttcttgttcagcaatagagatgaagccttctaatcatttttctgttcaactagtgtgtattcttttacagctatggctgggttggagatggattcgtggtcatctctaggattagcccaaaccccaagtgtgggaaaaatggggtgggtgtcctgatttggaaggttccagtgagccgacagtttgcagcctattgttacaactcatctgatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatactttta

SEQ ID NO: 149875 - DNA, 936 bp, Homo sapiens
  Payload ID: 9610
  Gene Symbol: LYVE1
  Gene Name: lymphatic vessel endothelial hyaluronan receptor 1
  ENST ID: ENST00000529598
  CDS Start-End: 46-702
agtggccatctgaggtgtttccctggctctgaaggggtaggcacgatggccaggtgcttcagcctggtgttgcttctcacttccatctggaccacgaggctcctggtccaaggctctttgcgtgcagaagatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacgg

SEQ ID NO: 149876 - DNA, 1490 bp, Homo sapiens
  Payload ID: 9611
  Gene Symbol: LYL1
  Gene Name: lymphoblastic leukemia associated hematopoiesis regulator 1
  Uniprot ID: P12980
  ENST ID: ENST00000264824
  CDS Start-End: 362-1204
cagcctggcccttatctgcactgggccagcatcctccggccgctgcgccgccaggggtgagagggaggaaaccgggccgccgggggcggggagaaggcgggccggcccgggagccgctcactttccctgggggggacctacgcggagacctcggctatcctggccttccgaggcccacgaggaggcgcggcccaacgccggggcctggagcattgaggccggaccctcgcgagacagcagagcctggcctgacgctggaaaccacaccctggcccagactgccagccctgacgggacagagccagggcactcaccaggctgcaagaacagtgctggggtgagtacccccacgtcggggtccatgtgcccgcctcaggcacaggcagaggtgggccccaccatgactgagaaggcagagatggtgtgtgcccccagcccagcgcctgccccaccccctaagcctgcctcgcctgggcccccgcaggtggaggaggtgggccaccgaggaggctcctcgccccccaggctgccacctggtgtaccagtgatcagcctgggccacagcaggcccccaggggtagccatgcccaccacagagctgggcactctgcggcccccgctgctgcaactctccaccctgggaactgccccgcccactttggccctgcactaccaccctcaccccttcctcaacagtgtctacattgggccagcaggaccttttagcatcttccctagcagccggttgaagcggagaccaagccactgtgagctggacctggctgaggggcaccagccccagaaggtggcccggcgcgtgttcaccaacagccgggagcgctggcggcagcagaacgttaacggcgccttcgccgagctgaggaagctgctgccgacgcacccgcccgaccggaagctgagcaagaacgaggtgctccgcctagccatgaagtacatcggcttcctggtgcggctgctgcgcgaccaagccgcagctctggccgcaggccccacccctcccgggcctcgcaaacggccggtgcaccgggtcccagacgacggcgcccgccggggatccggacgcagggccgaggcggcagcgcgctcgcagcccgcgcccccggccgaccccgacggcagccccggtggagcggcccggcccatcaagatggagcaaaccgctttgagcccagaggtgcggtgaccgcacgcggcagcacctctgagccggagggcaccagggactcggcccagggccgtcaaggaaagggcagtggacgtgctgcgcatgttcgggagcgaactcccccgaagaaggaccagtgaagacgtcaggggcaaggtctcgggggtccggaagggtgatcatcgacccccaagggacccgcagacccttaaaaaaatcacccacaaccctctggaagtggccttgcccggtccccttcccaggggcgaggtcggcaaagcaacatggcagagcagtcatagga

SEQ ID NO: 149877 - DNA, 902 bp, Homo sapiens
  Payload ID: 9611
  Gene Symbol: LYL1
  Gene Name: lymphoblastic leukemia associated hematopoiesis regulator 1
  ENST ID: ENST00000590974
  CDS Start-End: 731-902
gggagtgtgcaaagccaaagggcagactcggacataagaggaggcagcttccctgcctcagtttaccccctgcgtgcatccaggcacctccctccccggctgccctggggcccgggtccccagaggcccggggtccctacagtggctgggggagcggaaggcgaagccctgaggggtggcggaccgagtcctgccagcgccggctgggggcggggccgggaggcccgcgctgctaggtccccgcccgctggtttcctccggggtcagccaggctccttatcaggcgcggccaggcagcctggcccttatctgcactgggccagcatcctccggccgctgcgccgccaggggtgagagggaggaaaccgggccgccgggggcggggagaaggcgggccggcccgggagccgctcactttccctgggggggacctacgcggagacctcggctatcctggccttccgaggcccacgaggaggcgcggcccaacgccggggcctggagcattgaggccggaccctcgcgagacagcagagcctggcctgacgctggaaaccacaccctggcccagactgccagccctgacgggacagagccagggcactcaccaggctgcaagaacagtgctggggtggaggaggtgggccaccgaggaggctcctcgccccccaggctgccacctggtgtaccagtgatcagcctgggccacagcaggcccccaggggtagccatgcccaccacagagctgggcactctgcggcccccgctgctgcaactctccaccctgggaactgccccgcccactttggccctgcactaccaccctcaccccttcctcaacagtgtctacattgggccagcaggaccttttagcatcttccctagcagccggttgaagcgga

SEQ ID NO: 149878 - DNA, 804 bp, Homo sapiens
  Payload ID: 9612
  Gene Symbol: LY6D
  Gene Name: lymphocyte antigen 6 complex, locus D
  Uniprot ID: Q14210
  ENST ID: ENST00000301263
  CDS Start-End: 77-463
gcccacccccgcccagcccgtgcctataaggccttggcaatgcaggggcccgcactgctcccagacgacatcagagatgaggacagcattgctgctccttgcagccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccgcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttatttttgtactcaaatctctacatggagataaatgatttaaaccagtg

SEQ ID NO: 149879 - DNA, 1181 bp, Homo sapiens
  Payload ID: 9613
  Gene Symbol: LY6E
  Gene Name: lymphocyte antigen 6 complex, locus E
  Uniprot ID: Q16553
  ENST ID: ENST00000292494
  CDS Start-End: 163-558
cccggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagct

SEQ ID NO: 149880 - DNA, 1173 bp, Homo sapiens
  Payload ID: 9613
  Gene Symbol: LY6E
  Gene Name: lymphocyte antigen 6 complex, locus E
  Uniprot ID: Q16553
  ENST ID: ENST00000429120
  CDS Start-End: 157-552
ccggggccgcgcggctgcctgggaggctccgggccagccgcggtccagagcgcgcgaggttcggggagctcggccaggctgctggtacctgcgtccgcccggcggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccag

SEQ ID NO: 149881 - DNA, 1256 bp, Homo sapiens
  Payload ID: 9613
  Gene Symbol: LY6E
  Gene Name: lymphocyte antigen 6 complex, locus E
  Uniprot ID: Q16553
  ENST ID: ENST00000521699
  CDS Start-End: 239-634
cagccgcggtccagagcgcgcgaggttcggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagc

SEQ ID NO: 149882 - DNA, 857 bp, Homo sapiens
  Payload ID: 9613
  Gene Symbol: LY6E
  Gene Name: lymphocyte antigen 6 complex, locus E
  Uniprot ID: Q16553
  ENST ID: ENST00000522971
  CDS Start-End: 69-464
ttcggggagctcggccaggctgctggtacctgcgtccgcccggcggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctggggg

SEQ ID NO: 149883 - DNA, 740 bp, Homo sapiens
  Payload ID: 9613
  Gene Symbol: LY6E
  Gene Name: lymphocyte antigen 6 complex, locus E
  Uniprot ID: Q16553
  ENST ID: ENST00000521003
  CDS Start-End: 232-627
agagcgcgcgaggttcggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacagagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttg

SEQ ID NO: 149884 - DNA, 606 bp, Homo sapiens
  Payload ID: 9613
  Gene Symbol: LY6E
  Gene Name: lymphocyte antigen 6 complex, locus E
  ENST ID: ENST00000522528
  CDS Start-End: 111-236
agagcgcgcgaggttcggggagctcggccaggctgctggtacctgcgtccgcccggcggacaggctgctttggtttgtgacctccaggcaggacggccatcctctccagaatgaagatcttcttgccagtgctgctggctgcccttctgggtgtggagcgagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccc

SEQ ID NO: 149885 - DNA, 1335 bp, Homo sapiens
  Payload ID: 9613
  Gene Symbol: LY6E
  Gene Name: lymphocyte antigen 6 complex, locus E
  ENST ID: ENST00000517503
  CDS Start-End: 36-479
gaacagcccagcctggagcgggaagcagggacaagatgacctcaggaatcccaggctgcgggggtgcctgcgtcctcccctcccgagctccactccgcaggcgagacccccaacactgctccccgacactctccgaggcacccctcctccgtgctcacacccaaacacgtctgctcacccgtgggcttcccaccccgaacacaacgaggactgtccaggtgtcagtgacggtcaccccgacctggtcccctgtccggcctcgccaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccag

SEQ ID NO: 149886 - DNA, 868 bp, Homo sapiens
  Payload ID: 9613
  Gene Symbol: LY6E
  Gene Name: lymphocyte antigen 6 complex, locus E
  Uniprot ID: Q16553
  ENST ID: ENST00000522024
  CDS Start-End: 370-765
caggctgctggtacctgcgtccgcccggcggcctccccgaatgtttccaaagatctggggcgggagcgggcggagactgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgcccccggcatatcaccccggagcactggaacccgcccccgcttcttgttttggcactggtggtgcttgcggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatc

SEQ ID NO: 149887 - DNA, 971 bp, Homo sapiens
  Payload ID: 9613
  Gene Symbol: LY6E
  Gene Name: lymphocyte antigen 6 complex, locus E
  ENST ID: ENST00000519546
  CDS Start-End: 93-293
tcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgcctcatttcccatgcagggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagc

SEQ ID NO: 149888 - DNA, 1419 bp, Homo sapiens
  Payload ID: 9613
  Gene Symbol: LY6E
  Gene Name: lymphocyte antigen 6 complex, locus E
  Uniprot ID: Q16553
  ENST ID: ENST00000520466
  CDS Start-End: 404-799
cagagcgcgcgaggttcggggagctcggccaggctgctggtacctgcgtccgcccggcggcctccccgaatgtttccaaagatctggggcgggagcgggcggagactgccgccaggagcctcccggccgccccagggctgcgcagccactggagcccatcacccaactccagacgctcctggctcctctacgtgggccgggagggacagccttgaggactaggggagggggcacgggaccttgcagagctcctggccggaaagggaggattgaccgcccccggcatatcaccccggagcactggaacccgcccccgcttcttgttttggcactggtggtgcttgcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 149889 - DNA, 490 bp, Homo sapiens
  Payload ID: 9613
  Gene Symbol: LY6E
  Gene Name: lymphocyte antigen 6 complex, locus E
  ENST ID: ENST00000520531
  CDS Start-End: 112-333
cagagcgcgcgaggttcggggagctcggccaggctgctggtacctgcgtccgcccggcggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattggtgagtgccaggcctcagaccgtgccttcctcccctggccatctccctagcccgggccggggctcagcagaggccattgctgtctgtctgcagccgtctgtctctcccctgacagcctcatttcccatgcagggaatctcgtgacatttggccacagcctgagcaagacctgttccccggcctgccccatcccagaaggcgtcaatg

SEQ ID NO: 149890 - DNA, 427 bp, Homo sapiens
  Payload ID: 9613
  Gene Symbol: LY6E
  Gene Name: lymphocyte antigen 6 complex, locus E
  ENST ID: ENST00000523847
  CDS Start-End: 92-292
cggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattggtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgctaaa

SEQ ID NO: 149891 - DNA, 1079 bp, Homo sapiens
  Payload ID: 9613
  Gene Symbol: LY6E
  Gene Name: lymphocyte antigen 6 complex, locus E
  ENST ID: ENST00000521182
  CDS Start-End: 99-224
gggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggaccgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 149892 - DNA, 635 bp, Homo sapiens
  Payload ID: 9613
  Gene Symbol: LY6E
  Gene Name: lymphocyte antigen 6 complex, locus E
  ENST ID: ENST00000519611
  CDS Start-End: 212-412
cggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgcctcatttcccatgcagggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagacc

SEQ ID NO: 149893 - DNA, 1181 bp, Homo sapiens; identical to SEQ ID NO: 149879
  Payload ID: 9613
  Gene Symbol: LY6E
  Gene Name: lymphocyte antigen 6 complex, locus E
  Uniprot ID: Q16553
  ENST ID: ENST00000619718
  CDS Start-End: 163-558

SEQ ID NO: 149894 - DNA, 740 bp, Homo sapiens; identical to SEQ ID NO: 149883
  Payload ID: 9613
  Gene Symbol: LY6E
  Gene Name: lymphocyte antigen 6 complex, locus E
  Uniprot ID: Q16553
  ENST ID: ENST00000632516
  CDS Start-End: 232-627

SEQ ID NO: 149895 - DNA, 971 bp, Homo sapiens; identical to SEQ ID NO: 149887
  Payload ID: 9613
  Gene Symbol: LY6E
  Gene Name: lymphocyte antigen 6 complex, locus E
  ENST ID: ENST00000632618
  CDS Start-End: 93-293

SEQ ID NO: 149896 - DNA, 490 bp, Homo sapiens; identical to SEQ ID NO: 149889
  Payload ID: 9613
  Gene Symbol: LY6E
  Gene Name: lymphocyte antigen 6 complex, locus E
  ENST ID: ENST00000633934
  CDS Start-End: 112-333

SEQ ID NO: 149897 - DNA, 635 bp, Homo sapiens; identical to SEQ ID NO: 149892
  Payload ID: 9613
  Gene Symbol: LY6E
  Gene Name: lymphocyte antigen 6 complex, locus E
  ENST ID: ENST00000632902
  CDS Start-End: 212-412

SEQ ID NO: 149898 - DNA, 1335 bp, Homo sapiens; identical to SEQ ID NO: 149885
  Payload ID: 9613
  Gene Symbol: LY6E
  Gene Name: lymphocyte antigen 6 complex, locus E
  ENST ID: ENST00000633898
  CDS Start-End: 36-479

SEQ ID NO: 149899 - DNA, 1079 bp, Homo sapiens; identical to SEQ ID NO: 149891
  Payload ID: 9613
  Gene Symbol: LY6E
  Gene Name: lymphocyte antigen 6 complex, locus E
  ENST ID: ENST00000632978
  CDS Start-End: 99-224

SEQ ID NO: 149900 - DNA, 1173 bp, Homo sapiens; identical to SEQ ID NO: 149880
  Payload ID: 9613
  Gene Symbol: LY6E
  Gene Name: lymphocyte antigen 6 complex, locus E
  Uniprot ID: Q16553
  ENST ID: ENST00000632424
  CDS Start-End: 157-552

SEQ ID NO: 149901 - DNA, 1256 bp, Homo sapiens; identical to SEQ ID NO: 149881
  Payload ID: 9613
  Gene Symbol: LY6E
  Gene Name: lymphocyte antigen 6 complex, locus E
  Uniprot ID: Q16553
  ENST ID: ENST00000632519
  CDS Start-End: 239-634

SEQ ID NO: 149902 - DNA, 1419 bp, Homo sapiens; identical to SEQ ID NO: 149888
  Payload ID: 9613
  Gene Symbol: LY6E
  Gene Name: lymphocyte antigen 6 complex, locus E
  Uniprot ID: Q16553
  ENST ID: ENST00000632812
  CDS Start-End: 404-799

SEQ ID NO: 149903 - DNA, 868 bp, Homo sapiens; identical to SEQ ID NO: 149886
  Payload ID: 9613
  Gene Symbol: LY6E
  Gene Name: lymphocyte antigen 6 complex, locus E
  Uniprot ID: Q16553
  ENST ID: ENST00000633451
  CDS Start-End: 370-765

SEQ ID NO: 149904 - DNA, 427 bp, Homo sapiens; identical to SEQ ID NO: 149890
  Payload ID: 9613
  Gene Symbol: LY6E
  Gene Name: lymphocyte antigen 6 complex, locus E
  ENST ID: ENST00000633551
  CDS Start-End: 92-292

SEQ ID NO: 149905 - DNA, 606 bp, Homo sapiens; identical to SEQ ID NO: 149884
  Payload ID: 9613
  Gene Symbol: LY6E
  Gene Name: lymphocyte antigen 6 complex, locus E
  ENST ID: ENST00000632232
  CDS Start-End: 111-236

SEQ ID NO: 149906 - DNA, 857 bp, Homo sapiens; identical to SEQ ID NO: 149882
  Payload ID: 9613
  Gene Symbol: LY6E
  Gene Name: lymphocyte antigen 6 complex, locus E
  Uniprot ID: Q16553
  ENST ID: ENST00000631568
  CDS Start-End: 69-464

SEQ ID NO: 149907 - DNA, 2654 bp, Homo sapiens
  Payload ID: 9614
  Gene Symbol: LY6G5B
  Gene Name: lymphocyte antigen 6 complex, locus G5B
  Uniprot ID: Q8NDX9
  ENST ID: ENST00000375864
  CDS Start-End: 785-1390
accaggacagatttgtgctcagtggattgggtggtgtttttagtatggagcagaacagaattcctaggactgcgtgtgatgaaatgcaaggtcaaaaggaaaagacaaagcatatttcaaagatgagaaatatttgtttggatatctatgactgtctgtttatactgtaaggggcttaatcagcagctccatcttttagttttagttctaaaggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 149908 - DNA, 1903 bp, Homo sapiens
  Payload ID: 9614
  Gene Symbol: LY6G5B
  Gene Name: lymphocyte antigen 6 complex, locus G5B
  ENST ID: ENST00000383429
  CDS Start-End: 1-639
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 149909 - DNA, 1505 bp, Homo sapiens
  Payload ID: 9614
  Gene Symbol: LY6G5B
  Gene Name: lymphocyte antigen 6 complex, locus G5B
  Uniprot ID: Q8NDX9
  ENST ID: ENST00000409525
  CDS Start-End: 885-1325
ggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgttt

SEQ ID NO: 149910 - DNA, 1903 bp, Homo sapiens; identical to SEQ ID NO: 149908
  Payload ID: 9614
  Gene Symbol: LY6G5B
  Gene Name: lymphocyte antigen 6 complex, locus G5B
  ENST ID: ENST00000456439
  CDS Start-End: 1-639

SEQ ID NO: 149911 - DNA, 1903 bp, Homo sapiens
  Payload ID: 9614
  Gene Symbol: LY6G5B
  Gene Name: lymphocyte antigen 6 complex, locus G5B
  ENST ID: ENST00000437674
  CDS Start-End: 1-639
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctggtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 149912 - DNA, 1903 bp, Homo sapiens
  Payload ID: 9614
  Gene Symbol: LY6G5B
  Gene Name: lymphocyte antigen 6 complex, locus G5B
  ENST ID: ENST00000455499
  CDS Start-End: 1-639
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 149913 - DNA, 1870 bp, Homo sapiens
  Payload ID: 9614
  Gene Symbol: LY6G5B
  Gene Name: lymphocyte antigen 6 complex, locus G5B
  Uniprot ID: Q8NDX9
  ENST ID: ENST00000471674
  CDS Start-End: 1-606
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctggtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 149914 - DNA, 1870 bp, Homo sapiens
  Payload ID: 9614
  Gene Symbol: LY6G5B
  Gene Name: lymphocyte antigen 6 complex, locus G5B
  Uniprot ID: Q8NDX9
  ENST ID: ENST00000480530
  CDS Start-End: 1-606
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 149915 - DNA, 1870 bp, Homo sapiens
  Payload ID: 9614
  Gene Symbol: LY6G5B
  Gene Name: lymphocyte antigen 6 complex, locus G5B
  Uniprot ID: Q8NDX9
  ENST ID: ENST00000480515
  CDS Start-End: 1-606
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 149916 - DNA, 1870 bp, Homo sapiens
  Payload ID: 9614
  Gene Symbol: LY6G5B
  Gene Name: lymphocyte antigen 6 complex, locus G5B
  Uniprot ID: Q8NDX9
  ENST ID: ENST00000490011
  CDS Start-End: 1-606
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 149917 - DNA, 1870 bp, Homo sapiens; identical to SEQ ID NO: 149916
  Payload ID: 9614
  Gene Symbol: LY6G5B
  Gene Name: lymphocyte antigen 6 complex, locus G5B
  Uniprot ID: Q8NDX9
  ENST ID: ENST00000462244
  CDS Start-End: 1-606

SEQ ID NO: 149918 - DNA, 1870 bp, Homo sapiens; identical to SEQ ID NO: 149915
  Payload ID: 9614
  Gene Symbol: LY6G5B
  Gene Name: lymphocyte antigen 6 complex, locus G5B
  Uniprot ID: Q8NDX9
  ENST ID: ENST00000484964
  CDS Start-End: 1-606

SEQ ID NO: 149919 - DNA, 730 bp, Homo sapiens
  Payload ID: 9615
  Gene Symbol: LY6G5C
  Gene Name: lymphocyte antigen 6 complex, locus G5C
  Uniprot ID: Q5SRR4
  ENST ID: ENST00000324540
  CDS Start-End: 5-457
agtcatgcgttttatggcaggccctgcagggagccagagtctgggtcccctgtgcttccacagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcacaccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 149920 - DNA, 950 bp, Homo sapiens
  Payload ID: 9615
  Gene Symbol: LY6G5C
  Gene Name: lymphocyte antigen 6 complex, locus G5C
  ENST ID: ENST00000375863
  CDS Start-End: 1-677
atgcagaccttcccagttgctggggcgctggaccctgctatactggacacaaggtaggagcactcagaagggacaccgtcatctgctgctgtcgccatggcgattattcaacgccctgcctcttcaccccaggaaaaccttcgcggaacccgtcaccatggaaacgaactctctggactcttagcgcgccctgggctggccctgctgggtggacaggagaggagcaaaacgcaacaaagacgggattaattactcggaggccgcgccccctccgaagaaggccccaccctgccccggcctcacccctccccgaaataattcgaggaaatattccgcgaatgctgggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 149921 - DNA, 674 bp, Homo sapiens
  Payload ID: 9615
  Gene Symbol: LY6G5C
  Gene Name: lymphocyte antigen 6 complex, locus G5C
  Uniprot ID: Q5SRR4
  ENST ID: ENST00000383237
  CDS Start-End: 5-457
agtcatgcgttttatggcaggccctgcagggagccagagtctgggtcccctgtgcttccacagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcct

SEQ ID NO: 149922 - DNA, 730 bp, Homo sapiens; identical to SEQ ID NO: 149919
  Payload ID: 9615
  Gene Symbol: LY6G5C
  Gene Name: lymphocyte antigen 6 complex, locus G5C
  Uniprot ID: Q5SRR4
  ENST ID: ENST00000383425
  CDS Start-End: 5-457

SEQ ID NO: 149923 - DNA, 950 bp, Homo sapiens; identical to SEQ ID NO: 149920
  Payload ID: 9615
  Gene Symbol: LY6G5C
  Gene Name: lymphocyte antigen 6 complex, locus G5C
  ENST ID: ENST00000449871
  CDS Start-End: 1-677

SEQ ID NO: 149924 - DNA, 730 bp, Homo sapiens
  Payload ID: 9615
  Gene Symbol: LY6G5C
  Gene Name: lymphocyte antigen 6 complex, locus G5C
  Uniprot ID: Q5SRR4
  ENST ID: ENST00000418117
  CDS Start-End: 5-457
agtcatgcgttttatggcaggccctgcagggagccagagtctgggtcccctgtgcttccacagcagcccccaagccctctacacggtcctcttaatagtgctggtcatgatgagcttggtgtttggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 149925 - DNA, 730 bp, Homo sapiens; identical to SEQ ID NO: 149924
  Payload ID: 9615
  Gene Symbol: LY6G5C
  Gene Name: lymphocyte antigen 6 complex, locus G5C
  Uniprot ID: Q5SRR4
  ENST ID: ENST00000431114
  CDS Start-End: 5-457

SEQ ID NO: 149926 - DNA, 950 bp, Homo sapiens
  Payload ID: 9615
  Gene Symbol: LY6G5C
  Gene Name: lymphocyte antigen 6 complex, locus G5C
  ENST ID: ENST00000449562
  CDS Start-End: 1-677
atgcagaccttcccagttgctggggcgctggaccctgctatactggacacaaggtaggagcactcagaagggacaccgtcatctgctgctgtcgccatggcgattattcaacgccctgcctcttcaccccaggaaaaccttcgcggaacccgtcaccatggaaacgaactctctggactcttagcgcgccctgggctggccctgctgggtggacaggagaggagcaaaacgcaacaaagacgggattaattactcggaggccgcgccccctccgaagaaggccccaccctgccccggcctcacccctccccgaaataattcgaggaaatattccgcgaatgctgggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcacaccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 149927 - DNA, 950 bp, Homo sapiens; identical to SEQ ID NO: 149926
  Payload ID: 9615
  Gene Symbol: LY6G5C
  Gene Name: lymphocyte antigen 6 complex, locus G5C
  ENST ID: ENST00000450798
  CDS Start-End: 1-677

SEQ ID NO: 149928 - DNA, 950 bp, Homo sapiens; identical to SEQ ID NO: 149920
  Payload ID: 9615
  Gene Symbol: LY6G5C
  Gene Name: lymphocyte antigen 6 complex, locus G5C
  ENST ID: ENST00000411492
  CDS Start-End: 1-677

SEQ ID NO: 149929 - DNA, 950 bp, Homo sapiens; identical to SEQ ID NO: 149920
  Payload ID: 9615
  Gene Symbol: LY6G5C
  Gene Name: lymphocyte antigen 6 complex, locus G5C
  ENST ID: ENST00000435280
  CDS Start-End: 1-677

SEQ ID NO: 149930 - DNA, 950 bp, Homo sapiens; identical to SEQ ID NO: 149920
  Payload ID: 9615
  Gene Symbol: LY6G5C
  Gene Name: lymphocyte antigen 6 complex, locus G5C
  ENST ID: ENST00000432980
  CDS Start-End: 1-677

SEQ ID NO: 149931 - DNA, 730 bp, Homo sapiens; identical to SEQ ID NO: 149924
  Payload ID: 9615
  Gene Symbol: LY6G5C
  Gene Name: lymphocyte antigen 6 complex, locus G5C
  Uniprot ID: Q5SRR4
  ENST ID: ENST00000455753
  CDS Start-End: 5-457

SEQ ID NO: 149932 - DNA, 730 bp, Homo sapiens; identical to SEQ ID NO: 149924
  Payload ID: 9615
  Gene Symbol: LY6G5C
  Gene Name: lymphocyte antigen 6 complex, locus G5C
  Uniprot ID: Q5SRR4
  ENST ID: ENST00000458081
  CDS Start-End: 5-457

SEQ ID NO: 149933 - DNA, 538 bp, Homo sapiens
  Payload ID: 9615
  Gene Symbol: LY6G5C
  Gene Name: lymphocyte antigen 6 complex, locus G5C
  ENST ID: ENST00000474678
  CDS Start-End: 1-210
atggcaggccctgcagggagccagagtctgggtcccctgtgcttccacagcagcccccaagccctctacacggtcctcttaatagtgctggtcatgatgagcttggtgtttggtaagtggctccaagggttcagaagggtctcctggcctggatggagaaacccacagacaccaagtgtctgggtacacctgtccaggatgctcaggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttag

SEQ ID NO: 149934 - DNA, 992 bp, Homo sapiens
  Payload ID: 9616
  Gene Symbol: LY6G6C
  Gene Name: lymphocyte antigen 6 complex, locus G6C
  Uniprot ID: O95867
  ENST ID: ENST00000375819
  CDS Start-End: 167-544
ctggtcagctgcgtagtaagtgagaagggaggggctaccagaggcagggaagggaggagcctttgggtttataaattccaaaaaggccactcaactcctagagctggatccttgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgcaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaacccaggctcccatatgtaccccatcccccatactcacctctttccattttgagtaataaatgtctgagtctga

SEQ ID NO: 149935 - DNA, 992 bp, Homo sapiens
  Payload ID: 9616
  Gene Symbol: LY6G6C
  Gene Name: lymphocyte antigen 6 complex, locus G6C
  Uniprot ID: O95867
  ENST ID: ENST00000383413
  CDS Start-End: 167-544
ctggtcagctgcgtagtaagtgagaagggaggggctaccagaggcagggaagggaggagcctttgggtttataaattccaaaaaggccactcaactcctagagctggatccttgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgtaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaatccaggctcccatatgtaccccatcccccatactcacctctttccattttgagtaataaatgtctgagtctga

SEQ ID NO: 149936 - DNA, 992 bp, Homo sapiens; identical to SEQ ID NO: 149934
  Payload ID: 9616
  Gene Symbol: LY6G6C
  Gene Name: lymphocyte antigen 6 complex, locus G6C
  Uniprot ID: O95867
  ENST ID: ENST00000419939
  CDS Start-End: 167-544

SEQ ID NO: 149937 - DNA, 992 bp, Homo sapiens; identical to SEQ ID NO: 149934
  Payload ID: 9616
  Gene Symbol: LY6G6C
  Gene Name: lymphocyte antigen 6 complex, locus G6C
  Uniprot ID: O95867
  ENST ID: ENST00000448386
  CDS Start-End: 167-544

SEQ ID NO: 149938 - DNA, 992 bp, Homo sapiens; identical to SEQ ID NO: 149934
  Payload ID: 9616
  Gene Symbol: LY6G6C
  Gene Name: lymphocyte antigen 6 complex, locus G6C
  Uniprot ID: O95867
  ENST ID: ENST00000428498
  CDS Start-End: 167-544

SEQ ID NO: 149939 - DNA, 992 bp, Homo sapiens; identical to SEQ ID NO: 149934
  Payload ID: 9616
  Gene Symbol: LY6G6C
  Gene Name: lymphocyte antigen 6 complex, locus G6C
  Uniprot ID: O95867
  ENST ID: ENST00000428121
  CDS Start-End: 167-544

SEQ ID NO: 149940 - DNA, 992 bp, Homo sapiens; identical to SEQ ID NO: 149934
  Payload ID: 9616
  Gene Symbol: LY6G6C
  Gene Name: lymphocyte antigen 6 complex, locus G6C
  Uniprot ID: O95867
  ENST ID: ENST00000434915
  CDS Start-End: 167-544

SEQ ID NO: 149941 - DNA, 937 bp, Homo sapiens
  Payload ID: 9616
  Gene Symbol: LY6G6C
  Gene Name: lymphocyte antigen 6 complex, locus G6C
  ENST ID: ENST00000497123
  CDS Start-End: 280-489
atgaaagcccttatgctgctcaccctgtctgttctgctctgctgggtctcagatggttgcagtgacatctaagagcctccatggaaacagagcgttttcttgagccttctgaagaggggacaactgggccacttacctccagggtgaagtggatttcactgagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgcaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaacccaggctcccatatgtaccccatcccccatactcacctctttccattttgagtaataaatgtctgagtctga

SEQ ID NO: 149942 - DNA, 937 bp, Homo sapiens; identical to SEQ ID NO: 149941
  Payload ID: 9616
  Gene Symbol: LY6G6C
  Gene Name: lymphocyte antigen 6 complex, locus G6C
  ENST ID: ENST00000467714
  CDS Start-End: 280-489

SEQ ID NO: 149943 - DNA, 937 bp, Homo sapiens; identical to SEQ ID NO: 149941
  Payload ID: 9616
  Gene Symbol: LY6G6C
  Gene Name: lymphocyte antigen 6 complex, locus G6C
  ENST ID: ENST00000495859
  CDS Start-End: 280-489

SEQ ID NO: 149944 - DNA, 937 bp, Homo sapiens; identical to SEQ ID NO: 149941
  Payload ID: 9616
  Gene Symbol: LY6G6C
  Gene Name: lymphocyte antigen 6 complex, locus G6C
  ENST ID: ENST00000480025
  CDS Start-End: 280-489

SEQ ID NO: 149945 - DNA, 937 bp, Homo sapiens; identical to SEQ ID NO: 149941
  Payload ID: 9616
  Gene Symbol: LY6G6C
  Gene Name: lymphocyte antigen 6 complex, locus G6C
  ENST ID: ENST00000470881
  CDS Start-End: 280-489

SEQ ID NO: 149946 - DNA, 523 bp, Homo sapiens
  Payload ID: 9617
  Gene Symbol: LY6G6D
  Gene Name: lymphocyte antigen 6 complex, locus G6D
  ENST ID: ENST00000375824
  CDS Start-End: 1-523
atgaaaccccagtttgttgggatcttgctcagctccctgctaggggctgccttgggaaaccgaatgcggtgctacaactgtggtggaagccccagcagttcttgcaaagaggccgtgaccacctgtggcgagggcagaccccagccaggcctggaacagatcaagctacctggaaaccggaggtgttttttgagggggctgaaaatccctttgggctccttgaaatcacatctgctctgccccagaaggcaagtcctgaagccaggagtccaacaccccagtttcattctctctctcagccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 149947 - DNA, 402 bp, Homo sapiens
  Payload ID: 9617
  Gene Symbol: LY6G6D
  Gene Name: lymphocyte antigen 6 complex, locus G6D
  Uniprot ID: O95868
  ENST ID: ENST00000375825
  CDS Start-End: 1-402
atgaaaccccagtttgttgggatcttgctcagctccctgctaggggctgccttgggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 149948 - DNA, 523 bp, Homo sapiens; identical to SEQ ID NO: 149946
  Payload ID: 9617
  Gene Symbol: LY6G6D
  Gene Name: lymphocyte antigen 6 complex, locus G6D
  ENST ID: ENST00000383415
  CDS Start-End: 1-523

SEQ ID NO: 149949 - DNA, 402 bp, Homo sapiens; identical to SEQ ID NO: 149947
  Payload ID: 9617
  Gene Symbol: LY6G6D
  Gene Name: lymphocyte antigen 6 complex, locus G6D
  Uniprot ID: O95868
  ENST ID: ENST00000400080
  CDS Start-End: 1-402

SEQ ID NO: 149950 - DNA, 1266 bp, Homo sapiens
  Payload ID: 9617
  Gene Symbol: LY6G6D
  Gene Name: lymphocyte antigen 6 complex, locus G6D
  ENST ID: ENST00000400084
  CDS Start-End: 4-1152
cccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcactgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagacaaacatccttctgtgagtcattaaaatctatgaaccactct

SEQ ID NO: 149951 - DNA, 402 bp, Homo sapiens; identical to SEQ ID NO: 149947
  Payload ID: 9617
  Gene Symbol: LY6G6D
  Gene Name: lymphocyte antigen 6 complex, locus G6D
  Uniprot ID: O95868
  ENST ID: ENST00000419389
  CDS Start-End: 1-402

SEQ ID NO: 149952 - DNA, 523 bp, Homo sapiens; identical to SEQ ID NO: 149946
  Payload ID: 9617
  Gene Symbol: LY6G6D
  Gene Name: lymphocyte antigen 6 complex, locus G6D
  ENST ID: ENST00000456155
  CDS Start-End: 1-523

SEQ ID NO: 149953 - DNA, 402 bp, Homo sapiens; identical to SEQ ID NO: 149947
  Payload ID: 9617
  Gene Symbol: LY6G6D
  Gene Name: lymphocyte antigen 6 complex, locus G6D
  Uniprot ID: O95868
  ENST ID: ENST00000440095
  CDS Start-End: 1-402

SEQ ID NO: 149954 - DNA, 523 bp, Homo sapiens; identical to SEQ ID NO: 149946
  Payload ID: 9617
  Gene Symbol: LY6G6D
  Gene Name: lymphocyte antigen 6 complex, locus G6D
  ENST ID: ENST00000421590
  CDS Start-End: 1-523

SEQ ID NO: 149955 - DNA, 402 bp, Homo sapiens
  Payload ID: 9617
  Gene Symbol: LY6G6D
  Gene Name: lymphocyte antigen 6 complex, locus G6D
  Uniprot ID: O95868
  ENST ID: ENST00000434515
  CDS Start-End: 1-402
atgaaaccccagtttgttgggatcttgctcagctccctgctaggggctgccttgggaaaccgaatgcggtgctacaactgtggtggaagccccagcagtacttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 149956 - DNA, 402 bp, Homo sapiens; identical to SEQ ID NO: 149947
  Payload ID: 9617
  Gene Symbol: LY6G6D
  Gene Name: lymphocyte antigen 6 complex, locus G6D
  Uniprot ID: O95868
  ENST ID: ENST00000444880
  CDS Start-End: 1-402

SEQ ID NO: 149957 - DNA, 402 bp, Homo sapiens; identical to SEQ ID NO: 149947
  Payload ID: 9617
  Gene Symbol: LY6G6D
  Gene Name: lymphocyte antigen 6 complex, locus G6D
  Uniprot ID: O95868
  ENST ID: ENST00000420378
  CDS Start-End: 1-402

SEQ ID NO: 149958 - DNA, 1266 bp, Homo sapiens; identical to SEQ ID NO: 124864
  Payload ID: 9617
  Gene Symbol: LY6G6D
  Gene Name: lymphocyte antigen 6 complex, locus G6D
  ENST ID: ENST00000430366
  CDS Start-End: 4-1152

SEQ ID NO: 149959 - DNA, 1266 bp, Homo sapiens; identical to SEQ ID NO: 124864
  Payload ID: 9617
  Gene Symbol: LY6G6D
  Gene Name: lymphocyte antigen 6 complex, locus G6D
  ENST ID: ENST00000455955
  CDS Start-End: 4-1152

SEQ ID NO: 149960 - DNA, 523 bp, Homo sapiens
  Payload ID: 9617
  Gene Symbol: LY6G6D
  Gene Name: lymphocyte antigen 6 complex, locus G6D
  ENST ID: ENST00000430137
  CDS Start-End: 1-523
atgaaaccccagtttgttgggatcttgctcagctccctgctaggggctgccttgggaaaccgaatgcggtgctacaactgtggtggaagccccagcagtacttgcaaagaggccgtgaccacctgtggcgagggcagaccccagccaggcctggaacagatcaagctacctggaaaccggaggtgttttttgagggggctgaaaatccctttgggctccttgaaatcacatctgctctgccccagaaggcaagtcctgaagccaggagtccaacaccccagtttcattctctctctcagccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 149961 - DNA, 523 bp, Homo sapiens; identical to SEQ ID NO: 149946
  Payload ID: 9617
  Gene Symbol: LY6G6D
  Gene Name: lymphocyte antigen 6 complex, locus G6D
  ENST ID: ENST00000439522
  CDS Start-End: 1-523

SEQ ID NO: 149962 - DNA, 523 bp, Homo sapiens; identical to SEQ ID NO: 149946
  Payload ID: 9617
  Gene Symbol: LY6G6D
  Gene Name: lymphocyte antigen 6 complex, locus G6D
  ENST ID: ENST00000445443
  CDS Start-End: 1-523

SEQ ID NO: 149963 - DNA, 501 bp, Homo sapiens
  Payload ID: 9618
  Gene Symbol: LY6G6E
  Gene Name: lymphocyte antigen 6 complex, locus G6E (pseudogene)
  ENST ID: ENST00000383417
  CDS Start-End: 1-303
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcaggtaggactctggtccaatggcccttctccaggaggctccctacctccatccatccggcctttcctgtggcccccgcctcagcatgcctctttcatcccacagaccagagtgagatcactgagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactag

SEQ ID NO: 149964 - DNA, 383 bp, Homo sapiens
  Payload ID: 9618
  Gene Symbol: LY6G6E
  Gene Name: lymphocyte antigen 6 complex, locus G6E (pseudogene)
  ENST ID: ENST00000383418
  CDS Start-End: 1-378
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcaggaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactagcttcc

SEQ ID NO: 149965 - DNA, 501 bp, Homo sapiens; identical to SEQ ID NO: 149963
  Payload ID: 9618
  Gene Symbol: LY6G6E
  Gene Name: lymphocyte antigen 6 complex, locus G6E (pseudogene)
  ENST ID: ENST00000399142
  CDS Start-End: 1-303

SEQ ID NO: 149966 - DNA, 776 bp, Homo sapiens
  Payload ID: 9618
  Gene Symbol: LY6G6E
  Gene Name: lymphocyte antigen 6 complex, locus G6E (pseudogene)
  ENST ID: ENST00000409239
  CDS Start-End: 179-445
agagacaacatgctgagagagcagaggagaccctccaggcaagggcagactccttgcaggggcaggctgggggcccccgctgcctgctgggtcaggctggtgaatctggtcatggttccgccccccagattcactccctaggtgtgtttgtttactggttcctcactgtcttgctcaaatgctccaactctacaaatcccgggatctcggggtgcagatcacctctcccagattcctgagcctgtgtctggccatgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcagatgcccattgctgatgccccgtgtcagcccaggtcactggcaaggcaggcattttgatgacactgtggatctcaggcaaggggatcaaaggagcatcaggtatggtaaggaggagagtcttgctaggaaagactaatgtggtaggtcgggaactcaggatggagggcttgggggactatgaagagtacctttaataaaaggtctatctaggagtccagtaatactgcagatactgcagtgtgtgtgtgtgtgtgtgtgtgtgtgtgtgtgtgtgtctgtgtgtgtgtgctctaagagcaaactgtagctgcttggtgggttgggctggagctggaacctggacca

SEQ ID NO: 149967 - DNA, 501 bp, Homo sapiens; identical to SEQ ID NO: 149963
  Payload ID: 9618
  Gene Symbol: LY6G6E
  Gene Name: lymphocyte antigen 6 complex, locus G6E (pseudogene)
  ENST ID: ENST00000434670
  CDS Start-End: 1-303

SEQ ID NO: 149968 - DNA, 399 bp, Homo sapiens
  Payload ID: 9618
  Gene Symbol: LY6G6E
  Gene Name: lymphocyte antigen 6 complex, locus G6E (pseudogene)
  ENST ID: ENST00000419000
  CDS Start-End: 1-201
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcagaccagagtgagatcactgagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactag

SEQ ID NO: 149969 - DNA, 399 bp, Homo sapiens; identical to SEQ ID NO: 149968
  Payload ID: 9618
  Gene Symbol: LY6G6E
  Gene Name: lymphocyte antigen 6 complex, locus G6E (pseudogene)
  ENST ID: ENST00000435369
  CDS Start-End: 1-201

SEQ ID NO: 149970 - DNA, 501 bp, Homo sapiens; identical to SEQ ID NO: 149963
  Payload ID: 9618
  Gene Symbol: LY6G6E
  Gene Name: lymphocyte antigen 6 complex, locus G6E (pseudogene)
  ENST ID: ENST00000453077
  CDS Start-End: 1-303

SEQ ID NO: 149971 - DNA, 399 bp, Homo sapiens; identical to SEQ ID NO: 149968
  Payload ID: 9618
  Gene Symbol: LY6G6E
  Gene Name: lymphocyte antigen 6 complex, locus G6E (pseudogene)
  ENST ID: ENST00000450147
  CDS Start-End: 1-201

SEQ ID NO: 149972 - DNA, 399 bp, Homo sapiens; identical to SEQ ID NO: 149968
  Payload ID: 9618
  Gene Symbol: LY6G6E
  Gene Name: lymphocyte antigen 6 complex, locus G6E (pseudogene)
  ENST ID: ENST00000419767
  CDS Start-End: 1-201

SEQ ID NO: 149973 - DNA, 501 bp, Homo sapiens; identical to SEQ ID NO: 149963
  Payload ID: 9618
  Gene Symbol: LY6G6E
  Gene Name: lymphocyte antigen 6 complex, locus G6E (pseudogene)
  ENST ID: ENST00000446610
  CDS Start-End: 1-303

SEQ ID NO: 149974 - DNA, 501 bp, Homo sapiens; identical to SEQ ID NO: 149963
  Payload ID: 9618
  Gene Symbol: LY6G6E
  Gene Name: lymphocyte antigen 6 complex, locus G6E (pseudogene)
  ENST ID: ENST00000431420
  CDS Start-End: 1-303

SEQ ID NO: 149975 - DNA, 399 bp, Homo sapiens; identical to SEQ ID NO: 149968
  Payload ID: 9618
  Gene Symbol: LY6G6E
  Gene Name: lymphocyte antigen 6 complex, locus G6E (pseudogene)
  ENST ID: ENST00000430237
  CDS Start-End: 1-201

SEQ ID NO: 149976 - DNA, 399 bp, Homo sapiens; identical to SEQ ID NO: 149968
  Payload ID: 9618
  Gene Symbol: LY6G6E
  Gene Name: lymphocyte antigen 6 complex, locus G6E (pseudogene)
  ENST ID: ENST00000435051
  CDS Start-End: 1-201

SEQ ID NO: 149977 - DNA, 399 bp, Homo sapiens; identical to SEQ ID NO: 149968
  Payload ID: 9618
  Gene Symbol: LY6G6E
  Gene Name: lymphocyte antigen 6 complex, locus G6E (pseudogene)
  ENST ID: ENST00000443544
  CDS Start-End: 1-201

SEQ ID NO: 149978 - DNA, 501 bp, Homo sapiens; identical to SEQ ID NO: 149963
  Payload ID: 9618
  Gene Symbol: LY6G6E
  Gene Name: lymphocyte antigen 6 complex, locus G6E (pseudogene)
  ENST ID: ENST00000431644
  CDS Start-End: 1-303

SEQ ID NO: 149979 - DNA, 384 bp, Homo sapiens
  Payload ID: 9618
  Gene Symbol: LY6G6E
  Gene Name: lymphocyte antigen 6 complex, locus G6E (pseudogene)
  ENST ID: ENST00000469626
  CDS Start-End: 1-384
atgggcacctccagcatcttcctctgcgtgctgttcctctgtggggcactgggtctcaccatgtcccctgcccggggaaggctccgctgctacatctgtggcttcaccaaaccctgccaccctgttcccaccgagtgtcgggacgatgaagcttgtggcatcagtattggcacttcagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactagcttcc

SEQ ID NO: 149980 - DNA, 383 bp, Homo sapiens; identical to SEQ ID NO: 149964
  Payload ID: 9618
  Gene Symbol: LY6G6E
  Gene Name: lymphocyte antigen 6 complex, locus G6E (pseudogene)
  ENST ID: ENST00000548716
  CDS Start-End: 1-378

SEQ ID NO: 149981 - DNA, 383 bp, Homo sapiens; identical to SEQ ID NO: 149964
  Payload ID: 9618
  Gene Symbol: LY6G6E
  Gene Name: lymphocyte antigen 6 complex, locus G6E (pseudogene)
  ENST ID: ENST00000547676
  CDS Start-End: 1-378

SEQ ID NO: 149982 - DNA, 383 bp, Homo sapiens; identical to SEQ ID NO: 149964
  Payload ID: 9618
  Gene Symbol: LY6G6E
  Gene Name: lymphocyte antigen 6 complex, locus G6E (pseudogene)
  ENST ID: ENST00000548848
  CDS Start-End: 1-378

SEQ ID NO: 149983 - DNA, 383 bp, Homo sapiens; identical to SEQ ID NO: 149964
  Payload ID: 9618
  Gene Symbol: LY6G6E
  Gene Name: lymphocyte antigen 6 complex, locus G6E (pseudogene)
  ENST ID: ENST00000550508
  CDS Start-End: 1-378

SEQ ID NO: 149984 - DNA, 383 bp, Homo sapiens; identical to SEQ ID NO: 149964
  Payload ID: 9618
  Gene Symbol: LY6G6E
  Gene Name: lymphocyte antigen 6 complex, locus G6E (pseudogene)
  ENST ID: ENST00000546405
  CDS Start-End: 1-378

SEQ ID NO: 149985 - DNA, 383 bp, Homo sapiens; identical to SEQ ID NO: 149964
  Payload ID: 9618
  Gene Symbol: LY6G6E
  Gene Name: lymphocyte antigen 6 complex, locus G6E (pseudogene)
  ENST ID: ENST00000547421
  CDS Start-End: 1-378

SEQ ID NO: 149986 - DNA, 920 bp, Homo sapiens
  Payload ID: 9619
  Gene Symbol: LY6G6F
  Gene Name: lymphocyte antigen 6 complex, locus G6F
  Uniprot ID: Q5SQ64
  ENST ID: ENST00000375832
  CDS Start-End: 23-916
gagaacttggcaggctctccccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagagatgcctcgattcctcagttcaaacccgaaatccaggtctatgagaacatccatttggcccgtcttggcccacctgcccacaagcccaggtgatttt

SEQ ID NO: 149987 - DNA, 920 bp, Homo sapiens
  Payload ID: 9619
  Gene Symbol: LY6G6F
  Gene Name: lymphocyte antigen 6 complex, locus G6F
  Uniprot ID: Q5SQ64
  ENST ID: ENST00000383420
  CDS Start-End: 23-916
gagaacttggcaggctctccccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcactgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagagatgcctcgattcctcagttcaaacccgaaatccaggtctatgagaacatccatttggcccgtcttggcccacctgcccacaagcccaggtgatttt

SEQ ID NO: 149988 - DNA, 920 bp, Homo sapiens; identical to SEQ ID NO: 149986
  Payload ID: 9619
  Gene Symbol: LY6G6F
  Gene Name: lymphocyte antigen 6 complex, locus G6F
  Uniprot ID: Q5SQ64
  ENST ID: ENST00000453044
  CDS Start-End: 23-916

SEQ ID NO: 149989 - DNA, 920 bp, Homo sapiens; identical to SEQ ID NO: 149987
  Payload ID: 9619
  Gene Symbol: LY6G6F
  Gene Name: lymphocyte antigen 6 complex, locus G6F
  Uniprot ID: Q5SQ64
  ENST ID: ENST00000442105
  CDS Start-End: 23-916

SEQ ID NO: 149990 - DNA, 920 bp, Homo sapiens; identical to SEQ ID NO: 149986
  Payload ID: 9619
  Gene Symbol: LY6G6F
  Gene Name: lymphocyte antigen 6 complex, locus G6F
  Uniprot ID: Q5SQ64
  ENST ID: ENST00000446062
  CDS Start-End: 23-916

SEQ ID NO: 149991 - DNA, 920 bp, Homo sapiens; identical to SEQ ID NO: 149986
  Payload ID: 9619
  Gene Symbol: LY6G6F
  Gene Name: lymphocyte antigen 6 complex, locus G6F
  Uniprot ID: Q5SQ64
  ENST ID: ENST00000455632
  CDS Start-End: 23-916

SEQ ID NO: 149992 - DNA, 920 bp, Homo sapiens; identical to SEQ ID NO: 149986
  Payload ID: 9619
  Gene Symbol: LY6G6F
  Gene Name: lymphocyte antigen 6 complex, locus G6F
  Uniprot ID: Q5SQ64
  ENST ID: ENST00000447811
  CDS Start-End: 23-916

SEQ ID NO: 149993 - DNA, 951 bp, Homo sapiens
  Payload ID: 9620
  Gene Symbol: LY6H
  Gene Name: lymphocyte antigen 6 complex, locus H
  Uniprot ID: O94772
  ENST ID: ENST00000342752
  CDS Start-End: 130-615
ggtccgcgtctgcggctgcgttccccgaaagacgaggctgcgcccggattccggtccgcagggagaccgaagggcacagctccccgcgccgcgcacgccgcccgagcccggagtgcggacacccccgggatgcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgaga

SEQ ID NO: 149994 - DNA, 1056 bp, Homo sapiens
  Payload ID: 9620
  Gene Symbol: LY6H
  Gene Name: lymphocyte antigen 6 complex, locus H
  Uniprot ID: O94772
  ENST ID: ENST00000414417
  CDS Start-End: 235-720
gaccccaggggtctgcgaacccggacctgcgcgtggcgccgcgccgggtacctccccctctctgcgtctttgtgcattttgcttcctttcgcagtaaacgttcttccgagaaattccaaggggatctcagccaagcagagggggaagggatcctgcccacgcctggggagaccgaagggcacagctccccgcgccgcgcacgccgcccgagcccggagtgcggacacccccgggatgcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgaga

SEQ ID NO: 149995 - DNA, 925 bp, Homo sapiens
  Payload ID: 9620
  Gene Symbol: LY6H
  Gene Name: lymphocyte antigen 6 complex, locus H
  Uniprot ID: O94772
  ENST ID: ENST00000430474
  CDS Start-End: 167-589
agtggcaggtcccacccgctcccgcccctgccgctcattcctgtccggacgcacctgcagctccccggggagaagaggacgccccccatccgctcccccacacaggcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgaga

SEQ ID NO: 149996 - DNA, 925 bp, Homo sapiens; identical to SEQ ID NO: 149995
  Payload ID: 9620
  Gene Symbol: LY6H
  Gene Name: lymphocyte antigen 6 complex, locus H
  Uniprot ID: O94772
  ENST ID: ENST00000610554
  CDS Start-End: 167-589

SEQ ID NO: 149997 - DNA, 980 bp, Homo sapiens
  Payload ID: 9620
  Gene Symbol: LY6H
  Gene Name: lymphocyte antigen 6 complex, locus H
  Uniprot ID: O94772
  ENST ID: ENST00000615409
  CDS Start-End: 223-645
attttgcttcctttcgcagtaaacgttcttccgagaaattccaaggggatctcagccaagcagagggggaagggatcctgcccacgcctggggagaccgaagggcacagctccccgcgccgcgcacgccgcccgagcccggagtgcggacacccccgggatgcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgag

SEQ ID NO: 149998 - DNA, 1056 bp, Homo sapiens; identical to SEQ ID NO: 149994
  Payload ID: 9620
  Gene Symbol: LY6H
  Gene Name: lymphocyte antigen 6 complex, locus H
  Uniprot ID: O94772
  ENST ID: ENST00000615434
  CDS Start-End: 235-720

SEQ ID NO: 149999 - DNA, 951 bp, Homo sapiens; identical to SEQ ID NO: 149993
  Payload ID: 9620
  Gene Symbol: LY6H
  Gene Name: lymphocyte antigen 6 complex, locus H
  Uniprot ID: O94772
  ENST ID: ENST00000631670
  CDS Start-End: 130-615

SEQ ID NO: 150000 - DNA, 2671 bp, Homo sapiens
  Payload ID: 9621
  Gene Symbol: LY6K
  Gene Name: lymphocyte antigen 6 complex, locus K
  Uniprot ID: Q17RY6
  ENST ID: ENST00000292430
  CDS Start-End: 418-915
gagttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgaaaatatttccacgttttttcatggttgcgaagcagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttgattacctcttggtttgacttcccagggtcttgggatgggagagtggggatcaggtgcagttggctcttaaccctcaagggttctttaactcacattcagaggaagtccagatctcctgagtagtgattttggtgacaagtttttctctttgaaatcaaaccttgtaactcatttattgctgatggccactcttttccttgactcccctctgcctctgagggcttcagtattgatggggagggaggcctaagtaccactcatggagagtatgtgctgagatgcttccgacctttcaggtgacgcaggaacactgggggagtctgaatgattggggtgaagacatccctggagtgaaggactcctcagcatggggggcagtggggcacacgttagggctgcccccattccagtggtggaggcgctgtggatggctgcttttcctcaacctttcctaccagattccaggaggcagaagataactaattgtgttgaagaaacttagacttcacccaccagctggcacaggtgcacagattcataaattcccacacgtgtgtgttcaacatctgaaacttaggccaagtagagagcatcagggtaaatggcgttcatttctctgttaagatgcagccatccatggggagctgagaaatcagactcaaagttccaccaaaaacaaatacaaggggacttcaaaagttcacgaaaaaattgaattaaaagataaaaattaaaaaatgttttatttctcagcatgagctccatcaaggtcgagacgcttctgcaagtaatggtaccagccattcagttcatccctaaagaattgggcaccctgggaatttaaccatgccacttcagtctttgtgacgttattaactgaagaaaagtgggtgccctttaaagattttttaaaattataaaacagaagtaaccaaatcaggcctggaaggtgtatgcctagtgatttcccattgaaactctcacaaaactggccttgtttgatgagaggaatgagcaggagcattgtcatggtggagaagggctctctggtgaagctttccggggtgacgatttcctgggtgttttcctgctaaatcgttggctgactttctctatacactctcataataagatgttactgttctttggccctccagaaagtcaataagcaagatgccttgagcattcacaaaacggttgccacgacctttgcccttgacatgtctgcttttactctgatgggaccacgcccacctctaggtagtcattgctttgcttgtgctttgccttcaggagtgtactggttaagccacatttcatctccggctataattatatgaagaaatgcttcaggatcttgattccacttgtttaaaatggccatagaacgcttttctcttatctgcagctgagctgggagaaagttttggcacccaccgagtggacagtttactcaactttaatttcagtcagaattgtgtaagctgaacaccttgggatacctacagcgttggctattgtttctgctgctattaatcagtcctcttaaattagggcacaaacaagatgaattgtttcctcacagactgatgtggctggcctgctgctgtggacttcctctccaacatcatctcttctcttcttccaatgagttatccacttacttaa

SEQ ID NO: 150001 - DNA, 855 bp, Homo sapiens
  Payload ID: 9621
  Gene Symbol: LY6K
  Gene Name: lymphocyte antigen 6 complex, locus K
  ENST ID: ENST00000518841
  CDS Start-End: 416-718
gttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgaggagatcttcagggctcgtgaattctgattccgcccagcagtcactctccagcccttcggtatccacgaagttggtggggtgctgaggtgatgcttcagactcagtgtggcccacatcgactttataacttaatatggcaaaatgatttgtacagtgatgtataagatgaagtgtggtcatgagacaagacccccagctcagagtcgagccaggcccaccaag

SEQ ID NO: 150002 - DNA, 2724 bp, Homo sapiens
  Payload ID: 9621
  Gene Symbol: LY6K
  Gene Name: lymphocyte antigen 6 complex, locus K
  ENST ID: ENST00000522591
  CDS Start-End: 57-314
agaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgagtgagtatcttcgctcttgttggggacccaaaggcaggtgaacagagggctttcaggaatcagggctgtctagttttcctcaatggggaataactaatagaaagtagcctttttttttttttattttctgagacggagtcaggctggagtgcagtggtgtgatctcggctcactgcaacctcgccttccgggttcaagcgattctcctgcctcagcctccagagtagctggtattatggatgcgcgccaccacactggctaattttttatttttagtagaggtggggtttcaccatgttggtcaggctggtctcgaactcctgacctcaggtgacccacccgccctcggccccccaaagtgctgggattacaagcgtaagccaccgcgccctgcctttttttccctttaaaatgtgaagagcaaagtcctcagaggccagagagaggtgtaggaactgtgctagtgtaaggcagtgcctgctacagtgggtccagatgaaatactgggaggtaggaagaaaatctggatttcatatcatccatttttaaatgaaaaattaagctttaatagtgttaaatgcgccacagagaacagtgtctatgtcactcttacaagagatgcacaaaaccaaggtgtacagccttcaagtgtgttctcaaaggagggtgcatgccttaaaaattgtggagaccactgctctgtcatctgtgattcccctgaaaacctctgggtacatgaagccctccccaaggggaatctggacacccagcacattctgcccacagggagatcttcagggctcgtgaattctgattccgcccagcagtcactctccagcccttcggtatccacgaagttggtggggtgctgaggtgatgcttcagactcagtgtggcccacatcgactttataacttaatatggcaaaatgatttgtacagtgatgtataagatgaagtgtggtcatgagacaagacccccagctcagagtcgagccaggcccaccaagaggccagctccacaccctgggtgatggccagaatggctgggagtcatgtgtctgtctgtggtcacaaaggcctgagccaaccctgtgtttgagaagttgagacctgtttgttcccaaacagcaacccctagacccgcattcccagtgcatatggacaggccataccacgcagaagccagcccttccctgaagcagcattcaacacacaggcctggccctcgtcctcccgactcccccttggtgccccagttgactgtgcacctttgagcagggccgccaggggtgaggctttgacccagacagaagggcctcggtgtcaggcattggaattgcgtgattgccttctctcggtctttatttcctattagaaatatttccacgttttttcatggttgcgaagcagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttgattacctcttggtttgacttcccagggtcttgggatgggagagtggggatcaggtgcagttggctcttaaccctcaagggttctttaactcacattcagaggaagtccagatctcctgagtagtgattttggtgacaagtttttctctttgaaatcaaaccttgtaactcatttattgctgatggccactcttttccttgactcccctctgcctctgagggcttcagtattgatggggagggaggcctaagtaccactcatggagagtatgtgctgagatgcttccgacctttcaggtgacgcaggaacactgggggagtctgaatgattggggtgaagacatccctggagtgaaggactcctcagcatggggggcagtggggcacacgttagggctgcccccattccagtggtggaggcgctgtggatggctgcttttcctcaacctttcctaccagattccaggaggcagaagataactaattgtgttgaagaaacttagacttcacccaccagctggcacaggtgcacagattcataaattcccacacgtgtgtgttcaacatctgaaacttaggccaagtagagagcatcagggtaaatggcgttcatttctctgttaagatgcagccatccatggggagctgagaaatcagactcaaagttccaccaaaaacaaatacaaggggacttcaaaagttcacg

SEQ ID NO: 150003 - DNA, 963 bp, Homo sapiens
  Payload ID: 9621
  Gene Symbol: LY6K
  Gene Name: lymphocyte antigen 6 complex, locus K
  Uniprot ID: Q17RY6
  ENST ID: ENST00000519387
  CDS Start-End: 415-732
ttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgacagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttc

SEQ ID NO: 150004 - DNA, 6886 bp, Homo sapiens
  Payload ID: 9622
  Gene Symbol: LY75
  Gene Name: lymphocyte antigen 75
  Uniprot ID: O60449
  ENST ID: ENST00000263636
  CDS Start-End: 29-5197
ccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcggcatttaacttacatttgtactttatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagtaaaagtaaaa

SEQ ID NO: 150005 - DNA, 559 bp, Homo sapiens
  Payload ID: 9623
  Gene Symbol: LY86
  Gene Name: lymphocyte antigen 86
  Uniprot ID: O95711
  ENST ID: ENST00000230568
  CDS Start-End: 67-555
ggaagaaattttacaggctttttattggccggttatttttctgtgtgtcccatacaggcccccaccatgaagggtttcacagccactctcttcctctggactctgatttttcccagctgcagtggaggcggcggtgggaaagcctggcccacacacgtggtctgtagcgacagcggcttggaagtgctctaccagagttgcgatccattacaagattttggcttttctgttgaaaagtgttccaagcaattaaaatcaaatatcaacattagatttggaattattctgagagaggacatcaaagagctttttcttgacctagctctcatgtctcaaggctcatctgttttgaatttctcctatcccatctgtgaggcggctctgcccaagttttctttctgtggaagaaggaaaggagagcagatttactatgctgggcctgtcaataatcctgaatttactattcctcagggagaataccaggttttgctggaactgtacactgaaaaacggtccaccgtggcctgtgccaatgctactatcatgtgctcctgactgt

SEQ ID NO: 150006 - DNA, 1197 bp, Homo sapiens
  Payload ID: 9623
  Gene Symbol: LY86
  Gene Name: lymphocyte antigen 86
  Uniprot ID: O95711
  ENST ID: ENST00000379953
  CDS Start-End: 353-841
tccagagaccacatctgcagctcccaaaacaaggtctgttctgcagctggacaattcactgctaaaatcccaaacctaagagcagagccaaagccagaggagaggaaagtgacaatagggccaaagcctcattccagattccaaatgtcattctgtagccctcgtgctatcaactgctgcctgctggctgcagccaggtccctgggtccatacacagcctgcatcaagagcctgcagagactcgggggctggagatgggaaacagatggtggcctgcgctttgtctttcccaagtttacagcctcacctgggggtggaggctgttctgaggggcccccaagaggcccccaccatgaagggtttcacagccactctcttcctctggactctgatttttcccagctgcagtggaggcggcggtgggaaagcctggcccacacacgtggtctgtagcgacagcggcttggaagtgctctaccagagttgcgatccattacaagattttggcttttctgttgaaaagtgttccaagcaattaaaatcaaatatcaacattagatttggaattattctgagagaggacatcaaagagctttttcttgacctagctctcatgtctcaaggctcatctgttttgaatttctcctatcccatctgtgaggcggctctgcccaagttttctttctgtggaagaaggaaaggagagcagatttactatgctgggcctgtcaataatcctgaatttactattcctcagggagaataccaggttttgctggaactgtacactgaaaaacggtccaccgtggcctgtgccaatgctactatcatgtgctcctgactgtggcctgtagcaaaaatcacagccagctgcatctcgtgggacctccaagctcctctgactgaacctactgtgggaggagaagcagctgatgacagagagaggctctacaaagaagcgcccccaaagagtgcagctgctaattttagtcccaggaccagacatccccagactccacagatgtaatgaagtccccgaatgtatctgtttctaaggagcctcttggcagtccttaagcagtcttgagggtccatcctttttctctaattggtcgcctcccaccagactcacctgcttttcaactttttaggagtgcttcctcacagttaccaagaataaagaaagctggccaccat

SEQ ID NO: 150007 - DNA, 2443 bp, Homo sapiens
  Payload ID: 9624
  Gene Symbol: LY9
  Gene Name: lymphocyte antigen 9
  Uniprot ID: Q9HBG7
  ENST ID: ENST00000263285
  CDS Start-End: 31-1998
cttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataacctaaa

SEQ ID NO: 150008 - DNA, 1463 bp, Homo sapiens
  Payload ID: 9624
  Gene Symbol: LY9
  Gene Name: lymphocyte antigen 9
  ENST ID: ENST00000368035
  CDS Start-End: 1-1024
gaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 150009 - DNA, 2485 bp, Homo sapiens
  Payload ID: 9624
  Gene Symbol: LY9
  Gene Name: lymphocyte antigen 9
  Uniprot ID: Q9HBG7
  ENST ID: ENST00000368037
  CDS Start-End: 115-2040
acatacacatacacatgcacacacacactcatatacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccaacctcacatgcacagccagcaaccctgtcagcaggagttcccaccagtttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataacctaaa

SEQ ID NO: 150010 - DNA, 1364 bp, Homo sapiens
  Payload ID: 9624
  Gene Symbol: LY9
  Gene Name: lymphocyte antigen 9
  ENST ID: ENST00000368039
  CDS Start-End: 2-583
catggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctcaccgccgcgcagcagagctggaagggtcctgccgatgggaccctgccaggcccagtgccactgccccccgaggctgctagacgtgggcgttaggcgtgtcccacccacccgccgcctcccatggcacgtcgggaacaccggagccgccaacttggagactcctggtctgtgaagagccgctgacgcccgcaggaaccgggctgggccttgtgtgccagtggggtttgtgcttggtctttctccgcttggatttgcttatttattgcattgctggtagagactcccaagcctgtccaccctgcaaagactcctcgggcagcatgcgggtcccgcacactgcacccatttcctggatgtcccctgcaggcgcgggaggccatccgggcctgctggctgcggccccctctcagccaggcctggctcagcccactgcgtgggaggtcaccggccactccccgaggagctgggatccccgggatgcaggcccacagtgcggggctgcacccatgatgcggagctggcctccaaccctgcgggccgcgccaggcaccaactcagtgtttgtcagtgtttgtttttccaagaaatggttcaaattgctgctcagatttttaaatttactgtagctgccagtgtacacgtgtggaccccattttatttttacaccaatttggtgaaaatgctgctttcctcagcctccccacaattaaactgcacatggtctctaaaaaaa

SEQ ID NO: 150011 - DNA, 2213 bp, Homo sapiens
  Payload ID: 9624
  Gene Symbol: LY9
  Gene Name: lymphocyte antigen 9
  ENST ID: ENST00000392203
  CDS Start-End: 77-1774
atgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccagaacccacagctggccacacgctatactctgtgctctcccaaggatatgagaagctggacactcccctcaggcctgccaggcaacagcctacacccacctcagacagcagctctgacagcaacctcacaactgaggaggatgaggacaggcctgaggtgcacaagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataa

SEQ ID NO: 150012 - DNA, 801 bp, Homo sapiens
  Payload ID: 9624
  Gene Symbol: LY9
  Gene Name: lymphocyte antigen 9
  ENST ID: ENST00000490902
  CDS Start-End: 1-216
aagagtcacacagatgactgggctcctgggcctttctccagtaagccacagaggagtcagctgcaaatattctcttctgttctacagacctctctcctcttcctgctcatggaattcctggtggagtctgggtcccaaacccatctgttttggtctagaatttcaaaagtgctctccagagcctcggaagccctggaatctgggaatccaagctagggtcacccagaagacacccacagggtccctacaagaaaattaactgccttggccaaataccagcttcctagatgccttggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgcaccatttattgaaaagttgtccgtccacgtcatcgagggtgaccaccgcacactcctggagggcagcggcctggagtccatcatcagcaccctggctgagccacgtgtgagcgtgcgggagggctaggccctcgcccccacctgccactggagaccgctccgccatccccacctc

SEQ ID NO: 150013 - DNA, 847 bp, Homo sapiens
  Payload ID: 9624
  Gene Symbol: LY9
  Gene Name: lymphocyte antigen 9
  ENST ID: ENST00000474998
  CDS Start-End: 83-268
atacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacagaggagtcagctgcaaatattctcttctgttctacagacctctctcctcttcctgctcatgggcccaactcctgggaaacatctctccgctgcatggcccggaaccccactgtccagcagatagagccaatccagtaccccagagaggatctcagccacctgggactgtggcagctactgtccttctgtgctcccgctttctccagggcttcagggatgatggtgcaggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatggtgagttccagagagcttctgtgttttgatcttttcttttttttatttgtgcaaatttatggggtatgtgtgaaattttgttatatgtatatagtgcatactgatcaagtcagagttttcagtgtgtctgctgcctgagtacaat

SEQ ID NO: 150014 - DNA, 607 bp, Homo sapiens
  Payload ID: 9625
  Gene Symbol: LY96
  Gene Name: lymphocyte antigen 96
  Uniprot ID: Q9Y6Y9
  ENST ID: ENST00000284818
  CDS Start-End: 92-574
agttaaatcttttctgcttactgaaaaggaagagtctgatgattagttactgatcctctttgcatttgtaaagctttggagatattgaatcatgttaccatttctgtttttttccaccctgttttcttccatatttactgaagctcagaagcagtattgggtctgcaactcatccgatgcaagtatttcatacacctactgtgataaaatgcaatacccaatttcaattaatgttaacccctgtatagaattgaaaagatccaaaggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaagggaaaatacaaatgtgttgttgaagctatttctgggagcccagaagaaatgctcttttgcttggagtttgtcatcctacaccaacctaattcaaattagaataaattgagtatttaaaaaaaaatttaaagg

SEQ ID NO: 150015 - DNA, 430 bp, Homo sapiens
  Payload ID: 9625
  Gene Symbol: LY96
  Gene Name: lymphocyte antigen 96
  Uniprot ID: Q9Y6Y9
  ENST ID: ENST00000518893
  CDS Start-End: 18-410
tttggagatattgaatcatgttaccatttctgtttttttccaccctgttttcttccatatttactgaagctcagaagcagtattgggtctgcaactcatccgatgcaagtatttcatacacctactgtgggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaagggaaaatacaaatgtgttgttgaagctatttctgggagcccagaagaaatgctcttttgcttggagtttgtcatcctacaccaacctaattcaaattagaataaattgagtatttaaaa

SEQ ID NO: 150016 - DNA, 3787 bp, Homo sapiens
  Payload ID: 9626
  Gene Symbol: LCP1
  Gene Name: lymphocyte cytosolic protein 1 (L-plastin)
  Uniprot ID: P13796
  ENST ID: ENST00000323076
  CDS Start-End: 239-2122
caggtgatttttggtggggcggggacatgaaaaaaaagttaaaatgtccttataaagacaaaatctttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcaaagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccttgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccct

SEQ ID NO: 150017 - DNA, 3944 bp, Homo sapiens
  Payload ID: 9626
  Gene Symbol: LCP1
  Gene Name: lymphocyte cytosolic protein 1 (L-plastin)
  Uniprot ID: P13796
  ENST ID: ENST00000398576
  CDS Start-End: 390-2273
ggtgttgatgaacctgtgtgtgcagtcatagatacatcgtgtgtgtttgcaaaaatggcgaatgaggaaagatccagctctgacagaataatgagttgtgcaaagtgaaggccaaatgacatcaccggagatagcagtagttcaaagaaagcaaagcagaggaattgaactgctgcaaaatgcacgattcctccggcctcagatgaccaggcaccactagatacagaacactgtgctttccttctccaagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcaaagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggcccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttcatgtggcttcccttttctttgttcaagatgagggccaggaggggaaacatcacacctgccctaaaccctgttcctggaggtcagcatttgatctgttgcaagcccctctttctgtcccctcttcctaccctgcctcccttgactttgctcctcacacttttggaaccatgccttccgggggggcccatctcttctggccgtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaaaaatgaaaagagaatgatgctcaaaatctttccaaataaaatgttccctatatta

SEQ ID NO: 150018 - DNA, 753 bp, Homo sapiens
  Payload ID: 9626
  Gene Symbol: LCP1
  Gene Name: lymphocyte cytosolic protein 1 (L-plastin)
  ENST ID: ENST00000442275
  CDS Start-End: 556-753
ggcgggcgccgggaggggcaggcccagcccacggtgcagcgcgcgcggagccctcgccttcctccgacgcactgtggggctgcaggggaagctgcgggccgtgggggccggaggagaagccggctccacgcgcagctgctggcgaatgaggaaagatccagctctgacagaataatgagttgtgcaaagtgaaggccaaatgacatcaccggagatagcagtagttcaaagaaagcaaagcagaggaattgaactgctgcaaaatgcacgagtctcaaacattgtctcagcagcagcatcatatcttacaaaagttgaggaaatactgtatttccagcttaggaaactgaagattcctccggcctcagatgaccaggcaccactagatacagaacactgtgctttccttctccaagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagat

SEQ ID NO: 150019 - DNA, 819 bp, Homo sapiens
  Payload ID: 9626
  Gene Symbol: LCP1
  Gene Name: lymphocyte cytosolic protein 1 (L-plastin)
  ENST ID: ENST00000416500
  CDS Start-End: 82-819
atctgcctggggccagtgaggagaatgcatctagacagagcttttcgtgctgctgagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaa

SEQ ID NO: 150020 - DNA, 4678 bp, Homo sapiens
  Payload ID: 9627
  Gene Symbol: LCP2
  Gene Name: lymphocyte cytosolic protein 2 (SH2 domain containing leukocyte protein of 76kDa)
  Uniprot ID: Q13094
  ENST ID: ENST00000046794
  CDS Start-End: 617-2218
gacaactgtaaagaggcagctgaaagaatcccagtctttgatggtgggaggggaaagtggttggaaagcattaaaaaaacatgctccagcagttcactgatgtgggaaattgtctgtatttcaggtcaaccgtcaggatagattttggtctgcaaagccccagctgagcaagaatgcagtgtagacatatgggtgcccagagtttaaaggaaaattactcagactcacattggagtttaagaccccttcattgcctctcctactgggttggggtgactggagccagtggggaattaccaaccctgtggctctctctgcatctcaagcctccagagctgggcttccttgtttacttatttagagcccagcagaggaagtggtaaaggaaactagctgagtcgttttctgagaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgctttacttttttggtttcctaaaacaactttattgacttttagtccatactgttatatttttgtcttaaagaaaatttaaactacaaataccaaaagaaaacattttaaatttagggatgagactttggtgtatcgtgggtctaggtttaatgaacacatctggggttaagttggcatttcttcacatctccacacccacaccaaccatcacagccccccaccaaccttctcccaaccccaaaagcattgtccagggatatagattttaccaaaggcttcctgggaagacgagggagcaacactttagattaaatgtgatcagactttcctattagatatggctcttctgtctcttgttatccccctgacagctctgccataaagtcccttctcctcatccttcccaaacaggctgtataagtgctttgaggtaattaaactctttcctccagtttacaaatatcacttaacaaaaaatataggcattcagccagattaaaaaactggtattcagccaaatagtgacaatcagttgttcttcaagtttttccctttgggaccttggttgttattgcacaacttttattagcaacaatttttggcgtctctgcttaatctacaagttttcgaaatggaaaagagtatcttgcagcttcattttcatgagctaataaaaggggtattggaaggaatctaagaagtcaccattttaaaactgatgatatgttaaaataaggagtatgcagaaggtagagacttttaactgatgataaaaatggtgtttcacaaaatctcatccttaacaaccagaagttctcagtttagggtccaaaacttgggagtttaaggctgaaaaccctgcattcatttacacgtctacacaacgggctattcagcaagtatttacttagtggctcttctgtgttaaacaagtgagctaggtacaaggtagtaaggatagcatacaccataggttctagtatcgagtaagctccacttgtcttgctttgccgtattctatctttacaattcaaaaatatctaaaatgaaggacctgatagatttcaaagcaactatttggtagcgaatcatgtttataaaacaaaccaaagctcattttaagtctattagtggaaagtgccatcaggattaagatgttctgttccatggctatgactgaaatcaatgttgggaagctaatgttttcatgactagcattctctctctgttcaagcaccgacaactccttttggctgggccttgcctcttttggccacagaccttctatatgaccccaggtgcatcagtcacagttgctcagaaccctgctcagtgataaacatcttactaaagctgggtcaatcagggtcactctctggaatgttaaacatgaagcctgagacaagatctctcttttatctggggtccccaaaggcaatgctgtacacttggagctgcctgctgccctgcaactactcccatttaccaattatctggaagaaccagtctacaatagaagacaacgaggccaacacacaaaaacacagtaaaagtatggacaaattagtgggatccctgaaatctattccaactatgtgcttccaagtcacatgactcaataaatgcttcagctggttgagttgtgcttggcgttcactaccaggagagttctgattaataaaaactcattccatcaattaataatttagtagctctctttcaacctgagccaaattcaagcataagctaaaggataagcagtgacccatggccaatttcctatgtcatacacttgccattagtgacgtaagttaagccattcttcaaaacattaaacagccttcaagaaca

SEQ ID NO: 150021 - DNA, 1599 bp, Homo sapiens
  Payload ID: 9627
  Gene Symbol: LCP2
  Gene Name: lymphocyte cytosolic protein 2 (SH2 domain containing leukocyte protein of 76kDa)
  ENST ID: ENST00000521416
  CDS Start-End: 216-1202
atgctcactctgctgcctgcagaaaagagcttgcgtggcagagtctagaacagggagctcagataggaggctactgcggtagttcagtgaagaaatggacatggatgtttgtaggcagaacatgaagatgaggaaaagtgagcagatccagacaggttttgggagtgccggctcttgctgatgtattggaagtgcttcctaacgtttggatctttatgcagccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagcc

SEQ ID NO: 150022 - DNA, 666 bp, Homo sapiens
  Payload ID: 9627
  Gene Symbol: LCP2
  Gene Name: lymphocyte cytosolic protein 2 (SH2 domain containing leukocyte protein of 76kDa)
  ENST ID: ENST00000520344
  CDS Start-End: 247-666
aatgtgataggaggcttagcaggaaagtgacatgctcactctgctgcctgcagaaaagagcttgcgtggcagagtctagaacagggagctcagataggaggctactgcggtagttcagtgaagaaatggacatggatgtttgtaggcagaacatgaagatgaggaaaagtgagcagatccagacaggttttgggagtgccggctcttgctgatgtattggaagtgcttcctaacgtttggatctttatgcagccactgcccccaccccagaccaaccacgaagaacccagcagaagcagaaaccacaaaacggcaaagcgaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacag

SEQ ID NO: 150023 - DNA, 2421 bp, Homo sapiens
  Payload ID: 9627
  Gene Symbol: LCP2
  Gene Name: lymphocyte cytosolic protein 2 (SH2 domain containing leukocyte protein of 76kDa)
  ENST ID: ENST00000628092
  CDS Start-End: 208-1809
gaagagaccatatttgttcgcagaggaagccgttgctttctgggatctggctacgccagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggctggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgtaagtacaaaattgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccataatttatttattcttcttcaatgtttgtaaagtgcatgagtcatgttcacacttgaagtctagtagtgcactgtaataattcattttttaaaagattatttaatgcccatttcaaaatacagtagtttacacagctacagaaacaatttggggcaagttttaaaacactgaaacagtaatagttattggtgtcacataaaactgatttgttttttacagccaaacctctgtcagtcagaggcattcattagttttatacatgtaatttgaaaatcactaaacctcgttttctcagcagcaataatttaagaggcttcaaaaatataatttcactcttatttagtattttttcctgggggcatttttacgtaatttttttatgaaaagacaaatgcatgttgagataacttctgggattaaaatagtcttttgcttt

SEQ ID NO: 150024 - DNA, 1777 bp, Homo sapiens
  Payload ID: 9628
  Gene Symbol: LEXM
  Gene Name: lymphocyte expansion molecule
  Uniprot ID: Q3ZCV2
  ENST ID: ENST00000358193
  CDS Start-End: 55-1299
acaaggcccgggttgccgtggcagcagcggaggcgggcagcgcgcaggcctgccatgagggaaagccaggatgccgccggagctcatggctggaaccgcgtcggctccacggccaccaagtggttcaccggggcgcccttcggggtgcagagccacaggtttgacatctctgctgtttatcccaactggaagaagttcagcaccttcactgaggccccatactccacgcgttattctacccaagtgtcccacataggccctgggacttacagctccaaagagacctgcttcagcaagaagaagctgatgaaggaggtggacacaggctgggccaaggcccaggaagccacgcggctgacccagctaccccacttccagtaccaggccatcatgaaagagaagcggctgaaggagcaaaagctgggccccggctcctacaacctcaaagacttcttagaacagctgcgggagaaaccatgtagcacccgggggctgctcagctctggggaggttcgcttccgaggactcactgggaactactatccaggccctggaaattatggggagaagggtaacccatacaccaagctggaggagaatgcctggaaccggtctcattccgagggcctcatgtgcaggatgagcaacaagccacacccccggcctcatcaggggagtggtctgggacccggcacctacttcttcaaaagcgaccttgagacatatgtggcacgatccgtcggcacccgcggcccctatgacactttctctggtgatcggagcaagccactgccttatgggcactactccatgcagaaaaaaaagcccagggaactgatgaatttcaagagctttgtagaagaacttaactcacatcacaataagaagcatggggttttttctaaacttccccgaaacccgaaaacccctacagagaggatttactgggccaacctcagccagtgcccccgcacactggccacatctggccccagtttctggcttccacaagagaagaaatgcaaacccgtcaaccagcccccattcctgttgacctccaaggggtcaggtgcaaaggcctgccagatgattatgggaagctggaacccagtaggtgtgggccgctacctcaacacctggctgatggagacaaaggacaggcggcagcgatatcgatccctattcctgagtggatccaaacgctacctctcagacctggcccgggacatgctcatgcaaatcaggctgttttgttggaaaggcctagaagtcatcaattttggcctctcaccaatgtaggatctcctgtgaagcagaaccaacagggaaaggatcacaccatttactaagggaaagtgccctccaactgtggattacaattcagatcctactccttaaagccacatgcgaaggacagcctgcagtgaccagagagcccaaaggcctgaagacaaatctgggggtgacagcatgggcatgggagtggggtgtcttagagaaaggacacatgggcttgggagaggggagagatgtatggggatcacctttgccagagctgcatacctgaaggtcacagtgtcttccgggacagctggggacaggtatcttttgttgcaggagatcaattatcctgagaactcaactcagccagtgacatgaacatgggggccagagagcagatggactgaagggatgggacgtagttgacacttgtgggaccctttctattctaaagccagagtgcttggctccttgtttattaaagttcagaaagtgg

SEQ ID NO: 150025 - DNA, 1651 bp, Homo sapiens
  Payload ID: 9628
  Gene Symbol: LEXM
  Gene Name: lymphocyte expansion molecule
  Uniprot ID: Q3ZCV2
  ENST ID: ENST00000371273
  CDS Start-End: 16-1272
gcgcgcaggcctgccatgagggaaagccaggatgccgccggagctcatggctggaaccgcgtcggctccacggccaccaagtggttcaccggggcgcccttcggggtgcagagccacaggtttgacatctctgctgtttatcccaactggaagaagttcagcaccttcactgaggccccatactccacgcgttattctacccaagtgtcccacataggccctgggacttacagctccaaagagacctgcttcagcaagaagaagctgatgaaggaggtggacacaggctgggccaaggcccaggaagccacgcggctgacccagctaccccacttccagtaccaggccatcatgaaagagaagcggctgaaggagcaaaagctgggccccggctcctacaacctcaaagacttcttagaacagctgcgggagaaaccatgtagcacccgggggctgctcagctctggggaggttcgcttccgaggactcactgggaactactatccaggccctggaaattatggggagaagggtaacccatacaccaagctggaggagaatgcctggaaccggtctcattccgagggcctcatgtgcaggatgagcaacaagccacacccccggcctcatcaggggagtggtctgggacccggcacctacttcttcaaaagcgaccttgagacatatgtggcacgatccgtcggcacccgcggcccctatgacactttctctggtgatcggagcaagccactgccttatgggcactactccatgcagaaaaaaaagcccagggaactgatgaatttcaagagctttgtagaagaacttaactcacatcacaataagaagcatggggttttttctaaacttccccgaaacccgaaaacccctacagagaggatttactgggccaacctcagccagtgcccccgcacactggccacatctggccccagtttctggcttccacaagagaagaaatgcaaacccgtcaaccagcccccattcctgttgacctccaaggggtcaggtgcaaaggcctgccagatgattatgggaagctggaacccagtaggtgtgggccgctacctcaacacctggctgatggagacaaaggacaggcggcagcgatatcgatccctattcctgagtggatccaaacgctacctctcagacctggcccgggacatgctcatgcaggaaaggatcacaccatttactaagggaaagtgccctccaactgtggattacaattcagatcctactccttaaagccacatgcgaaggacagcctgcagtgaccagagagcccaaaggcctgaagacaaatctgggggtgacagcatgggcatgggagtggggtgtcttagagaaaggacacatgggcttgggagaggggagagatgtatggggatcacctttgccagagctgcatacctgaaggtcacagtgtcttccgggacagctggggacaggtatcttttgttgcaggagatcaattatcctgagaactcaactcagccagtgacatgaacatgggggccagagagcagatggactgaagggatgggacgtagttgacacttgtgggaccctttctattctaaagccagagtgcttggctccttgtttattaaagttcagaaagtgg

SEQ ID NO: 150026 - DNA, 1356 bp, Homo sapiens
  Payload ID: 9629
  Gene Symbol: LAX1
  Gene Name: lymphocyte transmembrane adaptor 1
  Uniprot ID: Q8IWV1
  ENST ID: ENST00000367217
  CDS Start-End: 167-1315
cttttcactctgctttgggtgttgaaggaagacgagcttctcacggagcctctcttgagcctcttggcagtttccccctctgtgcccctcacgtttccaccagaaacgtgaaggcagaggccacagattctccctgagccacctcacttggaagcaccatgtccggatgagatcgcacttcctgcagtgggcattagccacgtccagaaataaagaccagatcaccaacatcttttccgggtttgcgggactcctcgccatcctcctggtcgttgcggttttctgcatcttgtggaattggaataaacggaagaagcgacaagttccttacctccgagttaccgtcatgcccttgctgactttgccacaaaccagacaaagagccaaaaatatttatgacatcttgccttggcgacaggaagacctggggagacatgagtcgaggagtatgcgcattttcagtactgagagcctcctctccagaaattctgagagcccggagcatgtgccctcccaagcaggcaatgccttccaggagcatacagcccacatccatgccacagagtacgcggtgggtatctatgacaacgccatggtcccccagatgtgtgggaacctcactccctcggcacactgcatcaatgtcagagcttccagagactgcgcaagcatttcttcagaggattcgcatgattatgtcaatgtccccacagcagaagagattgctgagactctagcttctaccaaaagcccttccagaaatctctttgttcttcccagtacccagaagctggagtttactgaggaaagagatgagggctgtggagatgctggtgactgcaccagtttgtattctccaggagctgaggacagtgattcactcagcaatggagaaggttcttctcagatctcaaatgactatgtcaacatgacagggttggatctcagtgccatccaggaaaggcagctctgggtggcttttcagtgctgcagagactatgaaaatgttccagcagcagatcccagtggaagccagcagcaggctgagaaagatgtgccatcctcaaacataggtcatgtcgaggacaagacagatgatcccgggacccatgtccaatgtgtcaaaaggacattccttgcttcaggggattatgcagactttcagccattcacacagagtgaggacagtcagatgaaacatagagaagagatgtcaaatgaggactccagtgactatgaaaatgtgctaactgccaagttaggaggcagggactctgagcaggggcctggcactcagctccttcctgatgaatgaagacccaggtacccagccataaagccacattgagtagtcta

SEQ ID NO: 150027 - DNA, 3023 bp, Homo sapiens
  Payload ID: 9629
  Gene Symbol: LAX1
  Gene Name: lymphocyte transmembrane adaptor 1
  Uniprot ID: Q8IWV1
  ENST ID: ENST00000442561
  CDS Start-End: 391-1587
tcttttcactctgctttgggtgttgaaggaagacgagcttctcacggagcctctcttgagcctcttggcagtttccccctctgtgcccctcacgtttccaccagaaacgtgaaggcagaggccacagattctccctgagccacctcacttggaagcaccatgtccggatgagatcgcacttcctgcagtgggcattagccacgtccaggtagaaccaaacctgttgcttttgtatgttgggtcaacttggcctgacgtttcagaggtagacacgagatagggagtttgttgcgggggtggggagaagtggtagacatgctggctaactgattatgattaagagaaacttagaagctgaagccagagagcatctcaaaggttcctgatacaatggatggtgtcactccaaccctttcgacaatcagagggaggaccttggagtccagcactctgcatgtgactccccgcagcctggacagaaataaagaccagatcaccaacatcttttccgggtttgcgggactcctcgccatcctcctggtcgttgcggttttctgcatcttgtggaattggaataaacggaagaagcgacaagttccttacctccgagttaccgtcatgcccttgctgactttgccacaaaccagacaaagagccaaaaatatttatgacatcttgccttggcgacaggaagacctggggagacatgagtcgaggagtatgcgcattttcagtactgagagcctcctctccagaaattctgagagcccggagcatgtgccctcccaagcaggcaatgccttccaggagcatacagcccacatccatgccacagagtacgcggtgggtatctatgacaacgccatggtcccccagatgtgtgggaacctcactccctcggcacactgcatcaatgtcagagcttccagagactgcgcaagcatttcttcagaggattcgcatgattatgtcaatgtccccacagcagaagagattgctgagactctagcttctaccaaaagcccttccagaaatctctttgttcttcccagtacccagaagctggagtttactgaggaaagagatgagggctgtggagatgctggtgactgcaccagtttgtattctccaggagctgaggacagtgattcactcagcaatggagaaggttcttctcagatctcaaatgactatgtcaacatgacagggttggatctcagtgccatccaggaaaggcagctctgggtggcttttcagtgctgcagagactatgaaaatgttccagcagcagatcccagtggaagccagcagcaggctgagaaagatgtgccatcctcaaacataggtcatgtcgaggacaagacagatgatcccgggacccatgtccaatgtgtcaaaaggacattccttgcttcaggggattatgcagactttcagccattcacacagagtgaggacagtcagatgaaacatagagaagagatgtcaaatgaggactccagtgactatgaaaatgtgctaactgccaagttaggaggcagggactctgagcaggggcctggcactcagctccttcctgatgaatgaagacccaggtacccagccataaagccacattgagtagtctatcccataggattgactactgcagagtctagtgcagacccgtgatcaccttagtgcttcagtggattcactggttagattaaaaagaggctgagatgagcagtgaactaagaggccacacaaaagcagaggtttgggaattccagaagggaattcttctcaagcagagtgtggttatctcctgtaccagcctaagaatgtttgctgaaactgcttcctagaactgtgaagaaagcaggaaagtagtgcacagtagtctaagattattaccttcattaataccaacaggctgcaaagcaagagtatagattattgtataatccagtcagaggtcaaaaggaaggaagaagttggagtggagtggggtgggcaatttccattttaaagagtgtaggcaggccaggtgcagtggctcatgcctgtaatcccagcattttggtaggccgaggagggcagatcacttggtgccaggagttctagaccagcctggccaacatgacccatctttactaaaaatacaaaaattagccaggcgtggtggtgtgcccctgtaatcccagctactcaggaggctgaagcaggagaatcgcttgaacccgggaggtggaggttgcagcaagccgagattgtgccactgtactccagcctggtgacagagcgagactccctctcaaaaaaaaaaacaaacaaaaaagaagtgtgggcaaccaaatgtaggtaaggatgaagaagaacaggaactctcactggtggctgatgggattgcaaagcgtcagggcagctttgaaaaacttttcagcagtttcttataagcataacttatcatatggcccagccatttcactactagaaattgacgcaagtgaactgaaaacttatgttcacacaaaaactcgcacatgactgtttatagcagcttcattcataattaccaaaaactagaaataacccagatatccttcaacaggtgattggataagctgttgatatccattccttgagtttatccatactcaacagtaaaaaatgaactcttggttcacacaataatatagacatatcttaaatccattttgctaagtgaaagaagctaggcctaaaagtctacatgttgggcgattctatttatatgacattctggaaaaggcaaaactatagggatgaagaacagatcagttgttgtcaggtttgagaaaaggagggaagtttgctacaaaggggctgcaaagggaataggctgatggagctgttctgtatggtactgtgtggtggatacatgacaatatccatttgcaaacacaagaactatacacatggccaggcgcggtggctcacacccgtaatcccagcactttgcggggccgaggcaggggaacacaaggtcaggagatcaagac

SEQ ID NO: 150028 - DNA, 1974 bp, Homo sapiens
  Payload ID: 9630
  Gene Symbol: LAG3
  Gene Name: lymphocyte-activation gene 3
  Uniprot ID: P18627
  ENST ID: ENST00000203629
  CDS Start-End: 334-1911
agagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcatccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagc

SEQ ID NO: 150029 - DNA, 1576 bp, Homo sapiens
  Payload ID: 9630
  Gene Symbol: LAG3
  Gene Name: lymphocyte-activation gene 3
  Uniprot ID: P18627
  ENST ID: ENST00000441671
  CDS Start-End: 335-1417
cagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacaggtcagcctcaggtgggaaaggagtagctgccctcccagggtagaaaggacagggaggaagggctggcagggcaaagactaggcaaacccaccctgtgatgccaggccactgggcacaagttccagagcctgcccatctcggcccccacttttctcacccccataataaagaaacgaaactgaaaa

SEQ ID NO: 150030 - DNA, 1699 bp, Homo sapiens
  Payload ID: 9631
  Gene Symbol: LSP1
  Gene Name: lymphocyte-specific protein 1
  Uniprot ID: P33241
  ENST ID: ENST00000311604
  CDS Start-End: 176-1195
acaccctgacccaagccgagacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 150031 - DNA, 2016 bp, Homo sapiens
  Payload ID: 9631
  Gene Symbol: LSP1
  Gene Name: lymphocyte-specific protein 1
  Uniprot ID: P33241
  ENST ID: ENST00000381775
  CDS Start-End: 109-1512
ggtcaggccaggtcgccgcctgagcagaggctgcagcctgggcagtcccgggcttctgaggaggaactctagcagacagggcctggatacctcttgagatgcagagagatggctccgatctggtccccacctggcagggtctccggctgtcacctgagttcaggaccagcaccaggatctgcagtgggcccctggctgggcacacctcatcccagcctccccctacccctggccccccataagcctcctcctcctgggcttccaggctctgctggtcagacctccctccctgcccaacgggaatgtgttttcccaggggacgctgctgtccaccaggagctctgtggcctgggatttgaggagtgcctggggtcaatcccccaggctcaccagtgctacttaacaaatgggcccaagagaaggaagtgcagcccccggaggaggggcagagcccctgcctggctgtgcggtggctcacccccttgtcaccaggggctcggccatgagcatccgtccagcgggcccagcaccaactgcagccccaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 150032 - DNA, 1785 bp, Homo sapiens
  Payload ID: 9631
  Gene Symbol: LSP1
  Gene Name: lymphocyte-specific protein 1
  Uniprot ID: P33241
  ENST ID: ENST00000405957
  CDS Start-End: 448-1281
gggctggaagtcggtcttcggacagagcccgtcctgcccagaagcccaggcgagccagcagcaggggtgcagggaccgagtggcccagccccctgggcagggtgtcagggccagagcccagaggacggcggttcaggcttcagtcccagccggcgaaccagagctgggcagagcggccagcaagcggcagccagggtgccctgggcactcgacccccagatgcccctgctggaaccgtaaaggggaggcaccctgaggccagagggagcatggccccggggactgagcatccggctcagagcggcttggcagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 150033 - DNA, 2640 bp, Homo sapiens
  Payload ID: 9631
  Gene Symbol: LSP1
  Gene Name: lymphocyte-specific protein 1
  Uniprot ID: P33241
  ENST ID: ENST00000406638
  CDS Start-End: 1303-2136
ataccccattttgcaaacaggaaagctgaggctcagggaggcaccaaagcttactcccatcctggggcttggcagggggtgcccgcagcacccggggacatacaccggggagtctcctgggaaagaagtgccggcccaggggcagactcttttctgctctgccatgtcttccctgcacccccagggatgatgagtctgggaggggctggtcagccatgaaagcttcggggaggggccggtggccaggccgggcaccccagagctccacaggcagacatggtgtgggggtgtcaggaagagggcctggctgctgggtgctacggtaggaagatcccggtgctgtgggagtggagcaggtggttgaatgccaggctggcttggtccttctctctgggtgccggctgtggctcccgcccaggtgggcaccacgtctgaataatgtatgaagcctctggttgcgtggaggatgggagcgcttcgggcagcatctgtgggcagagacttcagggatgtgaggtacatctgggcatggctagctgggaaggaaagaggatggcagagcctcgagccgttgccagggactggttgcgtgtcccagaacgtgccaaaagcctgcctcgtgagcacggcaagagctctgccagggcagtcccagctggcccaggcgccgcagcgctcccgagggccgtcgagcaaaggcgggaggcgcagccgggctgtcggtggacctgtaggtatcagggctccttggtcccctcctgcgggaagcaggcaccgagtggggctgcatgtagacgcatgcgagggtgagagctgcggcggaggacgctgatcgcggagtgcaggcgagggccccagaaaggtcccgcaggtcgcctcgctcgtggcacgggctcggcagcgttgtggttagtgacacggaggaagacagaaagccatatgcacagcacgcagaacaggaggaggggggaagaaagagcaggcacggggcaggcagagccgcagccacgccgccgggatgcagcaggcagggccacccacgagcagggcggggccctaacctccgacccaggctggtcgccgcagatgggggcagagatgtgaaacagctgcagagcgggacaagggtgctgccggcacagggctgaccacagagcacatcaaaagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 150034 - DNA, 887 bp, Homo sapiens
  Payload ID: 9631
  Gene Symbol: LSP1
  Gene Name: lymphocyte-specific protein 1
  ENST ID: ENST00000457279
  CDS Start-End: 63-887
acacagcttcttggtgctccaaagacgggcggtaggaggaagatcaaagaagcgagaaatggatgctggaggaacgcagtgaggccaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaag

SEQ ID NO: 150035 - DNA, 582 bp, Homo sapiens
  Payload ID: 9631
  Gene Symbol: LSP1
  Gene Name: lymphocyte-specific protein 1
  ENST ID: ENST00000429923
  CDS Start-End: 58-582
ggtgcagaggaccaaggccggtccacttgacctcagccatgaggacatcccaaggccatgcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctg

SEQ ID NO: 150036 - DNA, 574 bp, Homo sapiens
  Payload ID: 9631
  Gene Symbol: LSP1
  Gene Name: lymphocyte-specific protein 1
  ENST ID: ENST00000446808
  CDS Start-End: 197-574
gagacggggaaggaggggacgggacaaagaggaaccagcgaagggtccaggcctgcgatgatggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagc

SEQ ID NO: 150037 - DNA, 581 bp, Homo sapiens
  Payload ID: 9631
  Gene Symbol: LSP1
  Gene Name: lymphocyte-specific protein 1
  ENST ID: ENST00000418975
  CDS Start-End: 216-581
ataccccattttgcaaacaggaaagctgaggctcagggaggcaccaaagcttactcccatcctggggcttggcagggggtgcccgcagcacccggggacatacaccggggagtctcctgggaaagaagtgccggcccaggggcagactcttttctgctctgccatgtcttccctgcacccccagggatgatgagtctgggaggggctggtcagccatgaaagcttcggggaggggccggtggccaggccgggcaccccagagctccacaggcagacatggtgtgggggtgtcaggaagagggcctggctgctgggtgctacggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcgga

SEQ ID NO: 150038 - DNA, 682 bp, Homo sapiens
  Payload ID: 9631
  Gene Symbol: LSP1
  Gene Name: lymphocyte-specific protein 1
  ENST ID: ENST00000421485
  CDS Start-End: 503-682
acagcctcacccttgcttccctcagtgttcccaaggtgctgcgcaaccccaactccctggcctggccagggtcatgatagctggggaggcaagaggtggctgttctccttgaatgtagggacagagggtggcatgggcagatgagtgcccgtgcacagatggtggcccaggactaattgggtggccagcggccggcagatctggctctggttctggctgtgccaggccctcactctgtgaccttggatgccagtgctgctggctggaccttggtttctccatcctggacatgggtacatggtggttctgagtgccagcgagctgggcaaaccgccggatgtgagactgccgtcgcggagctgaccctcggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctg

SEQ ID NO: 150039 - DNA, 968 bp, Homo sapiens
  Payload ID: 9631
  Gene Symbol: LSP1
  Gene Name: lymphocyte-specific protein 1
  ENST ID: ENST00000432093
  CDS Start-End: 303-968
gagcctcctcactccccaggaccccagagaggacggaccctctccagccgccctctgggctcaggacagccgggtggggcagccacaggagctgcctgcagggggcagagtcgggacggggaccgagccggacacccattctgcaagtgtctgcagggggaggacggaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaag

SEQ ID NO: 150040 - DNA, 417 bp, Homo sapiens
  Payload ID: 9631
  Gene Symbol: LSP1
  Gene Name: lymphocyte-specific protein 1
  ENST ID: ENST00000451814
  CDS Start-End: 224-417
gtgggctgagacccgggaggcttgagggtcggctgctacccatgacgggttggggaggtattggtgcgagctgaggtggtgcttgcggaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaa

SEQ ID NO: 150041 - DNA, 887 bp, Homo sapiens
  Payload ID: 9631
  Gene Symbol: LSP1
  Gene Name: lymphocyte-specific protein 1
  ENST ID: ENST00000417766
  CDS Start-End: 222-887
agggcagtcccagctggcccaggcgccgcagcgctcccgagggccgtcgagcaaaggcgggaggcgcagccgggctgtcggtggacctgcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaag

SEQ ID NO: 150042 - DNA, 1881 bp, Homo sapiens
  Payload ID: 9631
  Gene Symbol: LSP1
  Gene Name: lymphocyte-specific protein 1
  Uniprot ID: P33241
  ENST ID: ENST00000612798
  CDS Start-End: 544-1377
ttttgcaaacaggaaagctgaggctcagggaggcaccaaagcttactcccatcctggggcttggcagggggtgcccgcagcacccggggacatacaccggggagtctcctgggaaagaagtgccggcccaggggcagactcttttctgctctgccatgtcttccctgcacccccagggatgatgagtctgggaggggctggtcagccatgaaagcttcggggaggggccggtggccaggccgggcaccccagagctccacaggcagacatggtgtgggggtgtcaggaagagggcctggctgctgggtgctacggtaggaagatcccggtgctgtgggagtggagcaggtggttgaatgccaggctggcttggtccttctctctgggtgccggctgtggctcccgcccaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctca

SEQ ID NO: 150043 - DNA, 3068 bp, Homo sapiens
  Payload ID: 9632
  Gene Symbol: LEF1
  Gene Name: lymphoid enhancer-binding factor 1
  Uniprot ID: Q9UJU2
  ENST ID: ENST00000265165
  CDS Start-End: 656-1855
aagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcattt

SEQ ID NO: 150044 - DNA, 3477 bp, Homo sapiens
  Payload ID: 9632
  Gene Symbol: LEF1
  Gene Name: lymphoid enhancer-binding factor 1
  Uniprot ID: Q9UJU2
  ENST ID: ENST00000379951
  CDS Start-End: 1190-2350
agcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcattt

SEQ ID NO: 150045 - DNA, 1488 bp, Homo sapiens
  Payload ID: 9632
  Gene Symbol: LEF1
  Gene Name: lymphoid enhancer-binding factor 1
  Uniprot ID: Q9UJU2
  ENST ID: ENST00000438313
  CDS Start-End: 32-1147
acagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcactt

SEQ ID NO: 150046 - DNA, 1280 bp, Homo sapiens
  Payload ID: 9632
  Gene Symbol: LEF1
  Gene Name: lymphoid enhancer-binding factor 1
  Uniprot ID: Q9UJU2
  ENST ID: ENST00000506680
  CDS Start-End: 1-990
atgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgtgctctgcttttctcctcccccatcccttcctcattccttcaaccccttcccctaaccaccaccaccaccaccttttaggaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctga

SEQ ID NO: 150047 - DNA, 1037 bp, Homo sapiens
  Payload ID: 9632
  Gene Symbol: LEF1
  Gene Name: lymphoid enhancer-binding factor 1
  ENST ID: ENST00000515500
  CDS Start-End: 518-1037
ttttatttggggtttgggaccggatcaggccttaaatctacgcagaagaaaggcggagaagcagcggaagccgggcactagtcctgcagggtggaaggcgctttatcgggtcttctggcccgctgcgggcgatagagctggtaacctgagtagagtaaatagagacacgtgggtgctggctagagaaagcgcggagcagggccgcgctggagggctgtttgaagcctagtccagagctggtctagggggcggatggaccctgatacccgacactccactggtcacccttgttccacaactgggaaaccctctggaggaaatccggtagaaaagtcctgacacccgaatgatttaaccaacgccttttccctccaaagaaacttggaggatatacctttttttccttaaatggcatctttctacccccaaaaagaaagtgtgtggttttgagggcggggacattttgggttttaaacagcgcgtttaagaacacctcagatctgccttctctatcccaatggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggt

SEQ ID NO: 150048 - DNA, 1472 bp, Homo sapiens
  Payload ID: 9632
  Gene Symbol: LEF1
  Gene Name: lymphoid enhancer-binding factor 1
  Uniprot ID: Q9UJU2
  ENST ID: ENST00000510624
  CDS Start-End: 442-1353
actagtcctgcagggtggaaggcgctttatcgggtcttctggcccgctgcgggcgatagagctggtaacctgagtagagtaaatagagacacgtgggtgctggctagagaaagcgcggagcagggccgcgctggagggctgtttgaagcctagtccagagctggtctagggggcggatggaccctgatacccgacactccactggtcacccttgttccacaactgggaaaccctctggaggaaatccggtagaaaagtcctgacacccgaatgatttaaccaacgccttttccctccaaagaaacttggaggatatacctttttttccttaaatggcatctttctacccccaaaaagaaagtgtgtggttttgagggcggggacattttgggttttaaacagcgcgtttaagaacacctcagatctgccttctctatcccaatggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcg

SEQ ID NO: 150049 - DNA, 598 bp, Homo sapiens
  Payload ID: 9632
  Gene Symbol: LEF1
  Gene Name: lymphoid enhancer-binding factor 1
  ENST ID: ENST00000512172
  CDS Start-End: 22-459
agatctgccttctctatcccaatggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggtaagaaccttgctgcacccttcagccaggcatttgaacacatgttcctccactttccattcatggaaattagatttatgaatggtaacacttgtggagttgaagaaatttcacatcaacaagcaaggtgctaactttattca

SEQ ID NO: 150050 - DNA, 572 bp, Homo sapiens
  Payload ID: 9632
  Gene Symbol: LEF1
  Gene Name: lymphoid enhancer-binding factor 1
  ENST ID: ENST00000504950
  CDS Start-End: 7-408
atcccaatggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacagcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaag

SEQ ID NO: 150051 - DNA, 2504 bp, Homo sapiens
  Payload ID: 9633
  Gene Symbol: LRMP
  Gene Name: lymphoid-restricted membrane protein
  Uniprot ID: Q12912
  ENST ID: ENST00000354454
  CDS Start-End: 830-2329
aaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggg

SEQ ID NO: 150052 - DNA, 2715 bp, Homo sapiens
  Payload ID: 9633
  Gene Symbol: LRMP
  Gene Name: lymphoid-restricted membrane protein
  ENST ID: ENST00000361433
  CDS Start-End: 1070-2116
gatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttgaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttat

SEQ ID NO: 150053 - DNA, 2120 bp, Homo sapiens
  Payload ID: 9633
  Gene Symbol: LRMP
  Gene Name: lymphoid-restricted membrane protein
  ENST ID: ENST00000536173
  CDS Start-End: 506-1846
gacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcctatgatctttgaatgagctttttaaggaagaaatattatatattgtttgttaaagtttattgaaataaagaatcatttaaatcttc

SEQ ID NO: 150054 - DNA, 2193 bp, Homo sapiens
  Payload ID: 9633
  Gene Symbol: LRMP
  Gene Name: lymphoid-restricted membrane protein
  Uniprot ID: Q12912
  ENST ID: ENST00000548766
  CDS Start-End: 549-2048
aaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgcagtgttgccacaaactatatggtggtcaagaagcaagaatacatcagacacccctgaccttgaaacatacgtgctggtacacacctctgctgggtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttg

SEQ ID NO: 150055 - DNA, 1426 bp, Homo sapiens
  Payload ID: 9633
  Gene Symbol: LRMP
  Gene Name: lymphoid-restricted membrane protein
  ENST ID: ENST00000550945
  CDS Start-End: 1071-1426
agatgctgtcaaccaggaaggcatccttaggaagaggctccaagaaaccagccaacggctggaggatgtggaggagcaggtagggtggctcatggctacattagattcaggggacatctcctcagatgccctgcaaaccatgaaataaaaatggaggaggaacaacaacaacaaacaaaaaaaaaaagcaaagaggaactgcaagttcagtccctagcgactaacagtgagcagaggaagtaaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaa

SEQ ID NO: 150056 - DNA, 2208 bp, Homo sapiens
  Payload ID: 9633
  Gene Symbol: LRMP
  Gene Name: lymphoid-restricted membrane protein
  Uniprot ID: Q12912
  ENST ID: ENST00000547044
  CDS Start-End: 521-2020
tgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcc

SEQ ID NO: 150057 - DNA, 785 bp, Homo sapiens
  Payload ID: 9633
  Gene Symbol: LRMP
  Gene Name: lymphoid-restricted membrane protein
  ENST ID: ENST00000554942
  CDS Start-End: 556-785
attttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagacaacaattgagtcacttcaaaaggagttcattgaaggggaacaccatggcttgctgtttcagagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctgggtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccac

SEQ ID NO: 150058 - DNA, 463 bp, Homo sapiens
  Payload ID: 9633
  Gene Symbol: LRMP
  Gene Name: lymphoid-restricted membrane protein
  ENST ID: ENST00000555885
  CDS Start-End: 1-209
atgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagaggcagaaaaggaatcatacagaaaactgagcaataggaaatatcaattttaagcttcaaagaagagaatcgagtctatttccatttatgattaactgaggaaagagaatggtaactgattcagtcttgcagatgatgggcaagcctgctgtagggtactgagagaagaatgggggtgcagaggagtgtaacaactactattatccttccatatggtgaagttaccatacatttagagatgagctggaaaattagtaggcttagttttggatgaaggacattaaaattgagaaaccatggaaaagaa

SEQ ID NO: 150059 - DNA, 759 bp, Homo sapiens
  Payload ID: 9633
  Gene Symbol: LRMP
  Gene Name: lymphoid-restricted membrane protein
  ENST ID: ENST00000556887
  CDS Start-End: 736-759
ggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagacaacaattgagtcacttcaaaaggagttcattgaaggggaacaccatggcttgctgtttcagagctttttagatgaggaatttcctcactatgattccctgtcctgcgcagatgcaattcaacaacctcttcaagaaaaattgcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaa

SEQ ID NO: 150060 - DNA, 846 bp, Homo sapiens
  Payload ID: 9633
  Gene Symbol: LRMP
  Gene Name: lymphoid-restricted membrane protein
  ENST ID: ENST00000554272
  CDS Start-End: 456-644
ggaaactgaagacaacaattgagtcacttcaaaaggagttcattgaaggggaacaccatggcttgctgtttcagagctttttagatgaggaatttcctcactatgattccctgtcctgcgcagatgcaattcaacaacctcttcaagaaaaattgcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaa

SEQ ID NO: 150061 - DNA, 888 bp, Homo sapiens
  Payload ID: 9633
  Gene Symbol: LRMP
  Gene Name: lymphoid-restricted membrane protein
  ENST ID: ENST00000555877
  CDS Start-End: 1-292
tgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgcagacacacatgtagtgcctaccctgtgctagctaggcattatggacatcacagtgacacagaggactgtattccattggttaagatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggact

SEQ ID NO: 150062 - DNA, 1253 bp, Homo sapiens
  Payload ID: 9633
  Gene Symbol: LRMP
  Gene Name: lymphoid-restricted membrane protein
  ENST ID: ENST00000557489
  CDS Start-End: 892-1253
aaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagacaacaattgagtcacttcaaaaggagttcattgaaggggaacaccatggcttgctgtttcagagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaaca

SEQ ID NO: 150063 - DNA, 1507 bp, Homo sapiens
  Payload ID: 9634
  Gene Symbol: LTA
  Gene Name: lymphotoxin alpha
  ENST ID: ENST00000383303
  CDS Start-End: 259-876
tcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccacacagcaggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaacctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 150064 - DNA, 1422 bp, Homo sapiens
  Payload ID: 9634
  Gene Symbol: LTA
  Gene Name: lymphotoxin alpha
  ENST ID: ENST00000383304
  CDS Start-End: 174-791
ccaggggctccacacagcaggtgaggctctcctgccccatctccttgggctgcccgtgcttcgtgctttggactaccgccccgcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaacctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 150065 - DNA, 1422 bp, Homo sapiens
  Payload ID: 9634
  Gene Symbol: LTA
  Gene Name: lymphotoxin alpha
  ENST ID: ENST00000383499
  CDS Start-End: 174-791
ccaggggctccgcacagcaggtgaggctctcctgccccatctccttgggctgcccgtgcttcgtgctttggactaccgccccgcagtgtcctgccctctgcctgggcctcggtccctcctgcacctgctgcctggatccccggcctgcctgggcctgggccttggttctccccatgacaccacctgaacgtctcttcctcccaagggtgcgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 150066 - DNA, 1507 bp, Homo sapiens
  Payload ID: 9634
  Gene Symbol: LTA
  Gene Name: lymphotoxin alpha
  ENST ID: ENST00000400272
  CDS Start-End: 259-876
tcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggttctccccatgacaccacctgaacgtctcttcctcccaagggtgcgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 150067 - DNA, 1422 bp, Homo sapiens; identical to SEQ ID NO: 150065
  Payload ID: 9634
  Gene Symbol: LTA
  Gene Name: lymphotoxin alpha
  ENST ID: ENST00000441939
  CDS Start-End: 174-791

SEQ ID NO: 150068 - DNA, 1507 bp, Homo sapiens; identical to SEQ ID NO: 150066
  Payload ID: 9634
  Gene Symbol: LTA
  Gene Name: lymphotoxin alpha
  ENST ID: ENST00000456789
  CDS Start-End: 259-876

SEQ ID NO: 150069 - DNA, 1507 bp, Homo sapiens
  Payload ID: 9634
  Gene Symbol: LTA
  Gene Name: lymphotoxin alpha
  Uniprot ID: P01374
  ENST ID: ENST00000436519
  CDS Start-End: 259-876
tcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 150070 - DNA, 1507 bp, Homo sapiens; identical to SEQ ID NO: 150069
  Payload ID: 9634
  Gene Symbol: LTA
  Gene Name: lymphotoxin alpha
  Uniprot ID: P01374
  ENST ID: ENST00000426845
  CDS Start-End: 259-876

SEQ ID NO: 150071 - DNA, 1507 bp, Homo sapiens; identical to SEQ ID NO: 150069
  Payload ID: 9634
  Gene Symbol: LTA
  Gene Name: lymphotoxin alpha
  Uniprot ID: P01374
  ENST ID: ENST00000454783
  CDS Start-End: 259-876

SEQ ID NO: 150072 - DNA, 1422 bp, Homo sapiens; identical to SEQ ID NO: 150065
  Payload ID: 9634
  Gene Symbol: LTA
  Gene Name: lymphotoxin alpha
  ENST ID: ENST00000448630
  CDS Start-End: 174-791

SEQ ID NO: 150073 - DNA, 1422 bp, Homo sapiens
  Payload ID: 9634
  Gene Symbol: LTA
  Gene Name: lymphotoxin alpha
  Uniprot ID: P01374
  ENST ID: ENST00000412851
  CDS Start-End: 174-791
ccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 150074 - DNA, 1422 bp, Homo sapiens; identical to SEQ ID NO: 150073
  Payload ID: 9634
  Gene Symbol: LTA
  Gene Name: lymphotoxin alpha
  Uniprot ID: P01374
  ENST ID: ENST00000418386
  CDS Start-End: 174-791

SEQ ID NO: 150075 - DNA, 1507 bp, Homo sapiens; identical to SEQ ID NO: 150066
  Payload ID: 9634
  Gene Symbol: LTA
  Gene Name: lymphotoxin alpha
  ENST ID: ENST00000432632
  CDS Start-End: 259-876

SEQ ID NO: 150076 - DNA, 1422 bp, Homo sapiens; identical to SEQ ID NO: 150073
  Payload ID: 9634
  Gene Symbol: LTA
  Gene Name: lymphotoxin alpha
  Uniprot ID: P01374
  ENST ID: ENST00000454550
  CDS Start-End: 174-791

SEQ ID NO: 150077 - DNA, 897 bp, Homo sapiens
  Payload ID: 9635
  Gene Symbol: LTB
  Gene Name: lymphotoxin beta (TNF superfamily, member 3)
  Uniprot ID: Q06643
  ENST ID: ENST00000376117
  CDS Start-End: 9-743
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagat

SEQ ID NO: 150078 - DNA, 897 bp, Homo sapiens; identical to SEQ ID NO: 150077
  Payload ID: 9635
  Gene Symbol: LTB
  Gene Name: lymphotoxin beta (TNF superfamily, member 3)
  Uniprot ID: Q06643
  ENST ID: ENST00000383493
  CDS Start-End: 9-743

SEQ ID NO: 150079 - DNA, 897 bp, Homo sapiens; identical to SEQ ID NO: 150077
  Payload ID: 9635
  Gene Symbol: LTB
  Gene Name: lymphotoxin beta (TNF superfamily, member 3)
  Uniprot ID: Q06643
  ENST ID: ENST00000421268
  CDS Start-End: 9-743

SEQ ID NO: 150080 - DNA, 897 bp, Homo sapiens; identical to SEQ ID NO: 150077
  Payload ID: 9635
  Gene Symbol: LTB
  Gene Name: lymphotoxin beta (TNF superfamily, member 3)
  Uniprot ID: Q06643
  ENST ID: ENST00000444479
  CDS Start-End: 9-743

SEQ ID NO: 150081 - DNA, 897 bp, Homo sapiens; identical to SEQ ID NO: 150077
  Payload ID: 9635
  Gene Symbol: LTB
  Gene Name: lymphotoxin beta (TNF superfamily, member 3)
  Uniprot ID: Q06643
  ENST ID: ENST00000420402
  CDS Start-End: 9-743

SEQ ID NO: 150082 - DNA, 897 bp, Homo sapiens; identical to SEQ ID NO: 150077
  Payload ID: 9635
  Gene Symbol: LTB
  Gene Name: lymphotoxin beta (TNF superfamily, member 3)
  Uniprot ID: Q06643
  ENST ID: ENST00000456113
  CDS Start-End: 9-743

SEQ ID NO: 150083 - DNA, 897 bp, Homo sapiens; identical to SEQ ID NO: 150077
  Payload ID: 9635
  Gene Symbol: LTB
  Gene Name: lymphotoxin beta (TNF superfamily, member 3)
  Uniprot ID: Q06643
  ENST ID: ENST00000457552
  CDS Start-End: 9-743

SEQ ID NO: 150084 - DNA, 897 bp, Homo sapiens; identical to SEQ ID NO: 150077
  Payload ID: 9635
  Gene Symbol: LTB
  Gene Name: lymphotoxin beta (TNF superfamily, member 3)
  Uniprot ID: Q06643
  ENST ID: ENST00000429299
  CDS Start-End: 9-743

SEQ ID NO: 150085 - DNA, 853 bp, Homo sapiens
  Payload ID: 9635
  Gene Symbol: LTB
  Gene Name: lymphotoxin beta (TNF superfamily, member 3)
  Uniprot ID: Q06643
  ENST ID: ENST00000446745
  CDS Start-End: 11-244
ttcagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactgggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagat

SEQ ID NO: 150086 - DNA, 2260 bp, Homo sapiens
  Payload ID: 9636
  Gene Symbol: LTBR
  Gene Name: lymphotoxin beta receptor (TNFR superfamily, member 3)
  Uniprot ID: P36941
  ENST ID: ENST00000228918
  CDS Start-End: 327-1634
gctttcccggccgcccctcccgccccgcatcgaggcagacaagcctgttcctcttccctgggctgcgattgcgacaggccggcctggctcccagcgctccctgtccccgccccgcggccagctcgctccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgactgagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggac

SEQ ID NO: 150087 - DNA, 842 bp, Homo sapiens
  Payload ID: 9636
  Gene Symbol: LTBR
  Gene Name: lymphotoxin beta receptor (TNFR superfamily, member 3)
  ENST ID: ENST00000536876
  CDS Start-End: 190-842
ttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcagg

SEQ ID NO: 150088 - DNA, 632 bp, Homo sapiens
  Payload ID: 9636
  Gene Symbol: LTBR
  Gene Name: lymphotoxin beta receptor (TNFR superfamily, member 3)
  ENST ID: ENST00000544454
  CDS Start-End: 40-486
ctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcagaacctgccctgagcaagggggtggagaacttgcaagccctgctctaccaggcggccacaggcagttccgaagcaagtttccctactctctcacccctgtaaacacccccacaggaaccatgctgatgctggccgttctgctgccactggccttctttctgctccttgccaccgtcttctcctgcatctggaagagccacccttctctctgcaggaaactgggatcgctgctcaagaggcgtccgcag

SEQ ID NO: 150089 - DNA, 1084 bp, Homo sapiens
  Payload ID: 9636
  Gene Symbol: LTBR
  Gene Name: lymphotoxin beta receptor (TNFR superfamily, member 3)
  ENST ID: ENST00000541102
  CDS Start-End: 32-910
ctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgactgagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccc

SEQ ID NO: 150090 - DNA, 785 bp, Homo sapiens
  Payload ID: 9636
  Gene Symbol: LTBR
  Gene Name: lymphotoxin beta receptor (TNFR superfamily, member 3)
  ENST ID: ENST00000543190
  CDS Start-End: 428-652
ccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactggg

SEQ ID NO: 150091 - DNA, 1665 bp, Homo sapiens
  Payload ID: 9636
  Gene Symbol: LTBR
  Gene Name: lymphotoxin beta receptor (TNFR superfamily, member 3)
  Uniprot ID: P36941
  ENST ID: ENST00000539925
  CDS Start-End: 128-1378
actcccaggttgcggctggactgggactggttcctttccagttgaatctggcagccaaacctctcctccccctcacctgacaggtgcagcggcctggctggggagcccgcccgctggccggccagggatggaagcgacaggaatctcattagcatctcaattaaaggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgactgagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctg

SEQ ID NO: 150092 - DNA, 550 bp, Homo sapiens
  Payload ID: 9637
  Gene Symbol: LYN
  Gene Name: LYN proto-oncogene, Src family tyrosine kinase
  ENST ID: ENST00000520050
  CDS Start-End: 100-550
ggcagtgcttcagaattacacatcacatggggagcagcatgctcccactgtgccccagaagagtttcccggacagtgtccagagaatctgttcggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctg

SEQ ID NO: 150093 - DNA, 5808 bp, Homo sapiens
  Payload ID: 9637
  Gene Symbol: LYN
  Gene Name: LYN proto-oncogene, Src family tyrosine kinase
  Uniprot ID: P07948
  ENST ID: ENST00000520220
  CDS Start-End: 275-1750
agttcctctcccgccgcgccgggccgcgctgccgctcgctccccggccgtggcgcctccgggccagacgcgctgcagcctccagcccgcggcaagcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataacatctcaagctttttatttgcatttacattttcagctgtggtcagtgtaaaaattggtcatcagctgggggcggggtggttagaagtgattcaacagagctacatgctttaaacttgcccaagttctacctccttcctttgaacatttcagattggagaaccaaggagttgattgcctgaacacctgaacatccgtttatgggggccagatagaatttgttttcaaataggcttaacaggcatcattaaaatttcattctgtgtgttttgtttaggcttgaggtgcttagaagatgggataaaatattctacttttttctaaattttaactttgtttcctatgtgatttttttaaatgtcctttctaaaatattctaaaattattgattcacaagtgccatgttcagaactatagaatattactgttacataatgtctgcacagctggtcccttgattcagtggtaaggtttttgtgtacacccccctgcttgcattttatttcagaaccacaagtattacccaatatgttacatggagaggaactataaagaatccctaaggcaaaaagaagtctctagaaaatgactagaggttttttttttagcataacaaatttatttaaagaaaattattaaatttatcttcgccttgttttgcttctcccagttcctcctcttcttgccattttccacttgtctttccctcccaatcaagcctgtgatccttacctccatgtgggcccttcaccagcttgggcctcatctctggtgtccagcatgtgtggaagtcacacgttcccttgatgaacagcacacacagtctccttacttagctataggtttccagcctccctgtgacagacaggcataatgaggggctgaataggtgtttgtagcattttcgggtatccagtggtgtgcaaaatggctcatgtcatcacacctcaggttattgtagagaactggaaagacagaatccatactccctaccgccaagattctgacttagctgttgtgcagcgggagatgtatgtcagtctattttaaaagcttctccagtcagctagacacagtggctcatgcctgtaatctcagcactttgggaggctaaggcaggaggatcgcttgagctcaggagttagacaccagcctgagcaatatagcaagtctctacaaaaaattttaaaaattagctaagtgtggtggcacatacctatggtcccagctactcaggaggctgaggtgggaggattgcttgagcccaggaagtcaaggctgcagtgagctatgatcgtgccactgcactccagcctgggcaagagtgagaccctgtctcaaaaaaaaaaaccaaaaaaacaaaaaaacccttccctggtgaatataatgtatgctcagtcttgagagtcaccatttggtttgacccatattacaaagcccagccttctttttcctcagatggtttcatttctcaaaggggagtggaagagaaggaaggaggaaaaaaacgtgccttccttcctggtgaacatgaagctcactgaacctaaaggagactcacaggctagaaaccagtgtccttagtagtaggggccacctggggcttccgtggcttctccaggcatacctcctgaggttccacagaatccccttgcagaaagtacttctgatgagccactgggaacgtgtactgtccaagcccccttctaggggaaattcactgccacagaagccagcagccctggctgtcccaagggtgcataaaaggataataactaaaaggagggaattaattttgttgcctacaccagggatagatcgagggcactgaaagcatcataagtataaactcatctccacgtcagcttgtggagtctgctttctcgctctctcttttttttttttttttgacagagtctcactctgtcacgcaggctagagttgcagtggtgcgatctcagctcattgcaacctccccctctctggttggagcgattcttctcctgcctcagcctccctagtagctggaactacaggcacacaccatctcgcctggctaatttttgtatttttagtagagatggggtttcaccatgttagccaggctggtctcgaactcctgacctcaggcgatccgcctgcctcggcttcccaaagtgctgggattacaagtgtgagccactgtgcccggtcggggtctgctttctctttattccccgtcctctcacaaactacatccaggggcggtagctgctaaaaggactcaattctgcaacctcagcttctgacaccttcaaataaattaaatgctggtcctagggctcgctccccagctcttctgatgtcactgccaggttccacagccagttgtcggacatctcctgcttcctcagccaagaacacctctcagatgagatcaaaccgcccagctttcctcttagcatcttcctttattttccacttctggctggtggaagagagatcgtagttctctattccctacattttaactccacgaatattttagattaagtgaagtcttgctgttcttcctgatggaaatggtaattataaacatacaaagatacccatacacacattctttactcagggccctcttgtgctttggcaaatgataaaaattatctctaactcacacaacgaccctggaagatctggacaatgctatcactatttcacagctgagagatcgggagcatttaaagccacagaaggaatagattggcttcgcttcatattgtttccttgtgaaataaaaccagtgaaacac

SEQ ID NO: 150094 - DNA, 2297 bp, Homo sapiens
  Payload ID: 9637
  Gene Symbol: LYN
  Gene Name: LYN proto-oncogene, Src family tyrosine kinase
  Uniprot ID: P07948
  ENST ID: ENST00000519728
  CDS Start-End: 297-1835
tcggccgagcccagagacagccagttcctctcccgccgcgccgggccgcgctgccgctcgctccccggccgtggcgcctccgggccagacgcgctgcagcctccagcccgcggcaagcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgttt

SEQ ID NO: 150095 - DNA, 1626 bp, Homo sapiens
  Payload ID: 9638
  Gene Symbol: LYRM1
  Gene Name: LYR motif containing 1
  Uniprot ID: O43325
  ENST ID: ENST00000219168
  CDS Start-End: 370-738
ggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 150096 - DNA, 1659 bp, Homo sapiens
  Payload ID: 9638
  Gene Symbol: LYRM1
  Gene Name: LYR motif containing 1
  Uniprot ID: O43325
  ENST ID: ENST00000396052
  CDS Start-End: 401-769
gcctggtgtggggacgctcaggtgccggcgtggggccccctcggaggctgtgaatcttttggacccccgaatgtaaatgggagatgagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 150097 - DNA, 1399 bp, Homo sapiens
  Payload ID: 9638
  Gene Symbol: LYRM1
  Gene Name: LYR motif containing 1
  ENST ID: ENST00000412082
  CDS Start-End: 410-511
tttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaactcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 150098 - DNA, 1558 bp, Homo sapiens
  Payload ID: 9638
  Gene Symbol: LYRM1
  Gene Name: LYR motif containing 1
  Uniprot ID: O43325
  ENST ID: ENST00000439021
  CDS Start-End: 302-670
tttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 150099 - DNA, 769 bp, Homo sapiens
  Payload ID: 9638
  Gene Symbol: LYRM1
  Gene Name: LYR motif containing 1
  Uniprot ID: O43325
  ENST ID: ENST00000569023
  CDS Start-End: 401-769
aggagggagaatgggagaggggcaaggagggaacgagtggaagattgcgtcacgacgcacataaagacgtacgaagccgtcgccaaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaa

SEQ ID NO: 150100 - DNA, 931 bp, Homo sapiens
  Payload ID: 9638
  Gene Symbol: LYRM1
  Gene Name: LYR motif containing 1
  ENST ID: ENST00000562740
  CDS Start-End: 565-666
tgttggatgcggcgggagatgggtagagtcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaa

SEQ ID NO: 150101 - DNA, 857 bp, Homo sapiens
  Payload ID: 9638
  Gene Symbol: LYRM1
  Gene Name: LYR motif containing 1
  Uniprot ID: O43325
  ENST ID: ENST00000568663
  CDS Start-End: 342-710
aggacagaggaccagagtctgcaccccctccagggcagctccaaccccatatccccaggccctgggttgaggggtgctggcggtggggaggcagggacagtaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaactta

SEQ ID NO: 150102 - DNA, 1695 bp, Homo sapiens
  Payload ID: 9638
  Gene Symbol: LYRM1
  Gene Name: LYR motif containing 1
  ENST ID: ENST00000568820
  CDS Start-End: 278-601
agattgcgtcacgacgcacataaagacgtacgaagccgtcgccaaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccagtaagtgtgactccggttaacaagtgctgggtacttaccctcatcaacctggttatttccaagaatgtgtaacaagagggcgagtgcttgctgagaagcccagagctgctgtgggaggcatgttggaaataagctatcattgcatgctgccagcccatcacaacaaagtaaaatgtcaatgaatgcatgacgtatcctgcttacatagctttccacgtatggaagggaaaaccagctcacactgtagagctttttctcttttcactttcatcttttttatggaaatgtgtttaattataaaaggcaggtttgttgttactaaaagaataaagttcaaacatgaaaggaatgcataaagtagaaagtaaaaatggtcaaaaattctcatccaggctaggcactgcggctcatgcctataatcctagcactttgggaggccaaggcaggaggatcacttgaggctggtcttgaactcctgggctcaagcaatcctcccacctcagcctcccaaagctctgggataacaggcatgagccaccgtgcctggccagaaatcttttttgtttgttcgtttttttggagacagagtcttactctgtcgcccaggctggagtgcagcatgatttctgctcactacaacctctgccttcccagttcaagtgattctcattcctcaacctctcgaataggtggaactacagtcgtgcaccaccacacccagctaattttttgtattttaatagaaacagggtttcaccatgttgcccaggctggtcttgaactcctgagcttaggcaatctgcccaccgtggcctccaaaagtgctaggatgacaggcgtaagccactgcgcccagcccaaatttcttaaaaaaaaaaaaaaaaaaaaaaaatttctcattgtgcagagggtgaacactttaactgttaaatggaaaattgccaatattcaactcttttagctacaaaaacagcaattttatattgtagtggctcaacctaattagtttggtagtatacccttttagtctttttttctgtattcatgtacctacattttctttacatatgtaggattctggatataatgttatactgcgtacttattttacttcatgtcttctgcacatctttgtatgtagctctccctcaatctttttttttttt

SEQ ID NO: 150103 - DNA, 460 bp, Homo sapiens
  Payload ID: 9638
  Gene Symbol: LYRM1
  Gene Name: LYR motif containing 1
  Uniprot ID: O43325
  ENST ID: ENST00000567954
  CDS Start-End: 92-460
cacggctctgctgggctcctggcgccgcctcctcccagcccgccgcgggctgcgcgcttctgtgggtgggggaaggcaggactgacgcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaa

SEQ ID NO: 150104 - DNA, 931 bp, Homo sapiens
  Payload ID: 9638
  Gene Symbol: LYRM1
  Gene Name: LYR motif containing 1
  ENST ID: ENST00000567165
  CDS Start-End: 126-449
gcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccagtaagtgtgactccggttaacaagtgctgggtacttaccctcatcaacctggttatttccaagaatgtgtaacaagagggcgagtgcttgctgagaagcccagagctgctgtgggaggcatgttggaaataagctatcattgcatgctgccagcccatcacaacaaagtaaaatgtcaatgaatgcatgacgtatcctgcttacatagctttccacgtatggaagggaaaaccagctcacactgtagagctttttctcttttcactttcatcttttttatggaaatgtgtttaattataaaaggcaggtttgttgttactaaaagaataaagttcaaacatgaaaggaatgcataaagtagaaagtaaaaatggtcaaaaattctcatccaggctggtcttgaactcctgggctcaagcaatcctcccacctcagcctcccaaagctctgggataacaggcatgagccaccgtgcctggccagaaatcttttttgtttgttcgtttttttggagacagagtcttactctgtcgcccaggctggagtgcagcatg

SEQ ID NO: 150105 - DNA, 791 bp, Homo sapiens
  Payload ID: 9639
  Gene Symbol: LYRM2
  Gene Name: LYR motif containing 2
  ENST ID: ENST00000520441
  CDS Start-End: 19-252
ggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggtgagaacaaaatcatggcttcgcccacgactgaagcgcaagacctgaaggaggcaaacggcattgttacaaccactggtgtgcgcagcatctgtgtgagagaattctccttggacctggggctctgacctaatggaatttacagcttagagggtgagagcaggtgttcacatcaagcaagcacctctggaccacctaccatcctcctaggtcttgtcctgggcaccacggggactcggagacaggtaggatattatccctgacctcaagaagcttaaagtctatgatgataataactacagacactgatgctgggccgggactgccaactacatgcacagagactgtgctccagggagtgccattcacataaactaggatatgaatggcgtctcctggagttgtgcaacgcagcagccccgtgtgaggcacagtctcactctccatcttggtacactggacttgagctagcccagcagatgttcccttggccaaactgtgtccaagtcacatcaatttgattcaaaatattattaaagtgtatctatgagccatagtaccaaccacgggacagttatctcttcccc

SEQ ID NO: 150106 - DNA, 677 bp, Homo sapiens
  Payload ID: 9639
  Gene Symbol: LYRM2
  Gene Name: LYR motif containing 2
  ENST ID: ENST00000520318
  CDS Start-End: 34-252
gcgcgctgaggctccggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggtgagaacaaaatcatggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaaaggaaaaacacatcagaacagttgccttaacactgaaaaacataccctgcattttgaaaatgtttatggatgtctcagcagttcttaaaagaagaaaaaaaccactaacaaatggccagtagatgctggacacaatcattagggaagtgtaaatcaaaactactatgaggtcgggtgtagtggctcatgcttgtaatcccagtactttaggaggctgtggtaggtggatcacttga

SEQ ID NO: 150107 - DNA, 5353 bp, Homo sapiens
  Payload ID: 9639
  Gene Symbol: LYRM2
  Gene Name: LYR motif containing 2
  Uniprot ID: Q9NU23
  ENST ID: ENST00000523377
  CDS Start-End: 38-304
tcctgcgcgctgaggctccggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaaaggaaaaacacatcagaacagttgccttaacactgaaaaacataccctgcattttgaaaatgtttatggatgtctcagcagttcttaaaagaagaaaaaaaccactaacaaatggccagtagatgctggacacaatcattagggaagtgtaaatcaaaactactatgaggtcgggtgtagtggctcatgcttgtaatcccagtactttaggaggctgtggtaggtggatcacttgaggtcaggagttcaagaccagcctggccagcatggtgaaacctcatctctactaaaaatacaaaaattagcttggtgtggtggtgcattgcctgtagtcccagctacttgggaggctgaggcaggagaatcacttgaacccaggaagtggaggttgcagtgagctgaggtcgtgccactgcacttcagcctgggtgacagagtgagacagtctctaaaaaaaaaaaaaaaaaacaaccctgagattcacattcactagaatggctgtaattaaaaagagaaataataataagtcttggtgaagatgtacagaaattacagaaccctcatacattgctggtgggaatgtaaaatggtgtagccacttcagaaaacagacggtcagttcctcaaaagatgaaacagctgctgtatgagttagcacttctaccccatgcccatagccattatttggcactaaaaagaaacgaaggacttatatatactaaacatggataaaccttgaaaacgttaagtgaaagaagccggtcacaaaagatcacatgatgattccattcatacgaaatgtccagaataggcagaaagattagtggttgcctaggctggctgtagatggaatggagtaactgctaatgggtgtagggttccttttcagggtgatgaaaatatcctacagttagcttgtggtgtaggctgcacaactcttgaatatattcaaatccactgaactgtacattttaaatgtaaggtatgaattgtatctcaataaagctgttattaaaaaactcttgaggtgtaggactgaaagtatactgacaccaggagataccctggaactttctcgaaaaatcctgcattatccctgagggttgttcaggtacgttcttcagatgtgtcatagtttgatagagaactcatcaaaaagatcaccactgggaatctagatctttgttgaaaagggaagagaaagagaagcttaatgagcacattgaagcacttaccagaaagaagagggaagacttctggatgaaacctctgtgagtaccttaacattcacatggaagtagtaaaaataagattctgggtgcagttctccaatgacaggaaaaaaaacaaagagaatttgaagaatacgtcagagacaaatacattacaaccaaaattgacttcaaggcacttttgaaggagatcaaatttataacaaaataatttagtgaaagtgaaagcttgtggaagatgttggaatcatccatcctgaaaattgaagtcttctgtttatcaacagaacagctaagaagctaatctaagaatgaccagcacctgaaagatgtagacaacattttgcagaatgataaatggtatccagtactggactgtgtctgagaggcatcaactgaatgtggatgttaatgacctggactgtcagggtccacctctacctcccagagcctcagagcccacaagacaaaataattctgaatactgttccatgggggtaatctactaattcaaaatgcctgcctgtgccaattttcaggtttttatgtagataagtattagttaacctgttgcaaaatgatctgacaaacagaagcatttgtgacgtttctgaacagagaacactttggaaatattttttgtgtgacatgattgatagatacatgctatctctagtaaatctaaaatcttgaaactcaaaatcatccttttatgggtgtagaagtcagtgatttaatgatgctcttcctaacagtggtgtgcatggaaaggttttcattaaagagcgtatgtggtttgcatttgcaagattcaactagcacagactccaagaaaacctaagtttttttgttttttaaagcaggtaaggccgggcactgtggcttacacaagtaatccacacactttgggaggctgaggtgggtggatcactttaggtcaggatttcgagactagctaggccactagctagcctaacctggtggcacgtgcctgtaattccagctactcaggagggctgcctcatattgaacccgggaggcagaggctgcagtgagccgagaacacactactgcactacagcctgggcgaaagagtgagactcttgtctcaaaaaaaataaaaaagtgccatcaagttagaagttttaaattcatggtacaagcattgccatagatgtgcctgcaagaaacacacagatgacttttttttgagacagggtctctgttgcacaagctggagtgtggtggcgcgaacatggctcactgcaaccttgagctcctgggctcaagagatccacctgcttcagattttcatttagctgggaccacaggcatgtgccaccatgaccggctaattttttttacttttcagagagaggagggggaatctcactttgttgccaggctagtctcaaactcctgggctcaagcaatccacctgcctcggtggccagagtgctaggattacaggtgtgagttgtttttttttttaaagagacagtcttacctcattctgtcacccagaatggaatgactttctaaaattgcagaaagcagaacatattccttgctgtttataatattatagtcgtatcaaagggaaagagtatttctccttaaataaaattacaaataagaaatgtatgttttactcttactcataaaaggtattgtagaatacaaaaggtttttcaaactggttttgtctttgattggcttttataatccacacttcaaagaagaaatgcatttaacttttaataacttagtcaaaaagtataatgttgccttgccttgcataacctttaactattgcaaatgatgttttgtccttcccctttgtccagtattttccaaatggtcaacagtttaaacatttaagcttgcactgagaaaccttgccacatttcagcagttttgttttgcttttggtggagagcacctgatcgcgactttacagccaatgtatttactctaaattacacttttatagatacaaggtaaagtgtagctgggtgaaggcactcaggagccataaaatgtggtcaaccacaataaattaaaatgtaagctaaacaaagtattcacacttgcatttttttaataaggaatttaagatccatagtatctttaatgcttggaagagacacaaattcaaggtgataaaaatattaattagaagacacataacatgcctcaagtatatcaacacttgactccacaaacaaggcataaccatgaaaacaacactccctttattttgggctcccaaaatcaaaagttagaactaatttatttaatcacagatatttagtatactcaataatgcactaacaatttctttaaaaaaacactaatactgtacagtatttctgtgttttagtttttcccacagctgttgaaaatttcagccttgatttgaaacatgacctgcatgacaggctataagttgtcaatagttctttttctttggaaaagtacagttgtggcatttactcactttagcagatagctaaaagggaaaaataaggaaaaatatacactggacctgcagttaagtttttgacaatgccaaggatcaaaaacagatgaaacaacatttgctgaagatgaaaaggtattgcattggtcttaatagatgttgccatctctgggtgaggatgctgactgagcctgttctgtgtcttcatcacctctatttgtttcttcttctacgacagacctccaagagacaagatccatgtagtaagccacactaggtccttttgacccttctcattcttctgtagtctcttccctgtgacttttgacaaaaatactcagttcacaatattagctgcctgcttctgatgggtaggaggtaatcaaaatactcccaccaaagcactctatggtctagacttgatacttaaaatttagttttcagcattcctcaacaaggataccttgaggtaataggagatattttggtaagtgaaaataattcctgcttggaacacagcctactgaactcaggatttaatttcttgagtattaggcagttctcaataaattgatgtatactgaggaatgattctaaagaggttagtgatatcctgtttgagaatagatttagaaaactgaaggtactctccagctctacaattctgtattaggaacaatagggaaatgagaaagtgcctctatattgcaatctaatgagtctctgggggaagactgtctacctgcgtagtagttgagaacaagacaagctcccaaacacatgaaaatcaacttgaaataacatcaaattcagcctgggcaatatcatgagaccttatatctacaaaaaattagccaggactggtggcacacgcctgtagtcccaagctacttgcgaggttgaggcaggaggatcacgagcctgagaggccaaggctgcagtgaggtgtgatcatgccactgcactccagtctgggtgacagagcaagaccctgtctcaacaaaataaaaaacatcaaattcattccatattcaggtaacagtgacatatatctactgaattatttttcttttaggaatgtctatatctatggattgtcactataaaaaaaagaaaaaaccctaaaactgagcttgacaaagggaataaaagcatactttgtttttcttggtgtccccatgttaataaatcatttcttctctttggctcaa

SEQ ID NO: 150108 - DNA, 1941 bp, Homo sapiens
  Payload ID: 9639
  Gene Symbol: LYRM2
  Gene Name: LYR motif containing 2
  ENST ID: ENST00000412237
  CDS Start-End: 19-315
ggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggcttcgcccacgactgaagcgcaagacctgaaggaggcaaacggcattgttacaaccactggtgtgcgcagcatctgtgtgagagaattctccttggacctggggctctgacctaatggaatttacagcttagagggtgagagcaggtgttcacatcaagcaagcacctctggaccacctaccatcctcctaggtcttgtcctgggcaccacggggactcggagacagggcacacccttcgtggatgagcgccgcgatgatctccgtgttccccaccactgtggcccggtgcaaggcggtctggtccccctgcaaagtgacacaaaggcaggaacagcagtcagctcccctgcaccccctgcttgcactactcacttgacacttggacacaaggacccctcccgtccccacacagagcagagcggttattcgcagaagggcttggttaccacaggcaaggcgggctttgtggtcttgttagtagacaacgcacgctggcagagaaattttgttcataaactaagagggggaccttaagccgacagcaagaatagccctcggccacagagccaacctcaaaatgagggtcaggctctctcctgccatccaggggctatgactatcacaggtgtgaagagtgggtgtgagggcaggtgtgtgctatgcaattaaagcagcaatgcctggaatctctactgcctgccgagtttccagcttgcagggggaccactgtccagctctgccagttagcagcactcatgatttgatgacaggcgggtcatttgttcattgacctgtactagtcaacggcaatgcaggggtttgccctatttcatctgaggactccagggactgcagctatcactgcatatttctaagaagcctcttcagagagttcatgacaacatcctcactgatttatgctgcactctgagccctcttctctatgatcggattcctgggattgccggccgttgttctcctttaggcgccaaagggaacttgactcttcctaattgcagttgagtgaaggatgaaacactcccagaggtaagcaggtcaagactgtaacaggagagttctgaagtctctaagagcaccctttatctctgacaggtcctcaggaagctaagttgaggtaaatcaagctgagcctgtggtccagccttgaaagggaggatgggtgggcagtgtggaaatgttctggtggaaagcaatgagcacgagacaaggggtcaggaggcctgggctgtgcatggcttgctagaagcctgtcaccctgctggacctcaggtgtgtcaccctggatgatcccagggtccctccattgccttcttggattctatgatgtggctggtcagagttttgtgaagtttcctggcagagcaccagaggggcaaagaaaacattctggggcgtccctggtgcttggcccaaaagaggacagaggccatcataagataaaacagattttttaaaagaaggatgcactgctacctataaacaaccttaacgaaatactgattctacttactaaactccccagatctgtaacaaacaatgcacattaaaaacatgtaatctgaaacaaagttctaaagatagatggtggtgatggttgcacaacaatgtgagtgtacttaatgccactgaaccgtatacgtaaatatgttcagacagtaaatttaatgctatgtatattttattacaataaaaaatcctagttaaaactcaaaa

SEQ ID NO: 150109 - DNA, 696 bp, Homo sapiens
  Payload ID: 9639
  Gene Symbol: LYRM2
  Gene Name: LYR motif containing 2
  ENST ID: ENST00000626778
  CDS Start-End: 1-297
atggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggcttcgcccacgactgaagcgcaagacctgaaggaggcaaacggcattgttacaaccactggtgtgcgcagcatctgtgtgagagaattctccttggacctggggctctgacctaatggaatttacagcttagagggtgagagcaggtgttcacatcaagcaagcacctctggaccacctaccatcctcctaggtcttgtcctgggcaccacggggactcggagacaggcagctgggattcccagagaaaattctgcaaaacccatgctgaagtgaagaggaaccgaggccagaggccaaatgcaccttagcagagagctcctggagagaaggctagaaagataagaaactgaggctcaaagaagttaagcaacttgcacaattagcaaacaaagcagagttaaaatctgtgagcaggtgccctaactacagagtctgcactctctcccatttgtgattgcctgggccctggaaagtgctatgggtagatcacacaagctctgagttaag

SEQ ID NO: 150110 - DNA, 1487 bp, Homo sapiens
  Payload ID: 9640
  Gene Symbol: LYRM4
  Gene Name: LYR motif containing 4
  ENST ID: ENST00000463032
  CDS Start-End: 1-223
aacatatgctgtcaggaggataagagatgccttcagagaaaataaaaatgtaaaggatcctgtagaaattcaaaccctagtgaataaagccaagagagaccttggagtaattcgtcgacagataacggaatctcgctctgtcacccaggctggagtgcagtggcgtgatctcagcaacctccacctcccaggttcaaaccattcttctgcctcagcctcctgagtagctgggattattggcgcgtgccaccatggcctatatatttttagtagagacagggtttcaccgtgttggtcaggctggtctcagacttgtgacctcgtgatccacccgtctcgacctcccgaagtgctggaattataggcgtaagccactgcacccatcctcacctgcactcttactggccccttaactgggtcccctcgccacaactctccacctcttcttcgccttgacctgaagacaaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactgggga

SEQ ID NO: 150111 - DNA, 1168 bp, Homo sapiens
  Payload ID: 9640
  Gene Symbol: LYRM4
  Gene Name: LYR motif containing 4
  ENST ID: ENST00000468929
  CDS Start-End: 10-132
ctttccaaaatggcagcctccagtcgcgcacaagtgttatctctgtaccgggcgatgctgagagagagcaagcgtttcagcgcctacaattacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgctttta

SEQ ID NO: 150112 - DNA, 7312 bp, Homo sapiens
  Payload ID: 9640
  Gene Symbol: LYRM4
  Gene Name: LYR motif containing 4
  Uniprot ID: Q9HD34
  ENST ID: ENST00000330636
  CDS Start-End: 207-482
gcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgcttttattcttggaaacagattcattccaaacatagaaagaacatattaaataacttgcttgtcatctggggagtttacgagggaccagacctggcagagcggtttcttgtttccctttgcatacagtgctcagtggatttggtatctgtgggttaaggtttggaacaggctcctataaatagcaccggtcctggaatagctgcagcactgtcaccccctcattttaactccgacggtcatgggagtgagtacgcactgtctgagcccgtgttcttctcaccctcatatgagaactcatgtcttccagtcgcttttagagagcatagatttgctgcaatgatgcgttcaaatagatgtaacgtgtagccattctatttggcagtacaacttttgatttcaggataaagtctttttttttgagatggagtctcgctctgtcacccaggctggagtgcagcggtgcgatcttggctcactgcaacctccacctcctgggttcaagccattctcctgcctcagcctcccgagtagctgggattacaggggcctgccaccacgcccagctaattttttgtatttttaatagagacggggtttcactatgttggccaggctggtcttgaactcctcggccccccaaagtgctggtattacaggcatgaaccaccaccccctgccaatttcaggataaagtcctgagcatctgtgaaaataatgaagctcttagcaagtcccagatctcttaccctctaaccagttcctgcctgggagctgcagtgttagagcatatgcaaagccctaattgggggagagctgttcggtggacagtgaacggaggtgatgtggcaagtataatcactcccttcagctgactgtcacggggcagagccgcccagcccagccctgtgtgtggctctggctcaggttttccaccttgcatcagtgcagtggagttcgtggtcactcagcagtgaatgcatccaaccacgctactaacgcacggcactgctgatttatacttaatttaagcaactgctacttggaaccgaagtccagatttgaacctccgtgctgaaggcatcaaattgccggcaagataacagctccagaggagacttctcccactcccccaggttttacgcaatgaggcagtccacccaaacttaacgtgggctgcaggctgtaacagcaggttgcttttgtgttcattaaactgcatgaatgggtttgaacatgcccaaagccttgctaatgcagacttaattttgtaaaattaactatgcctttggaatctgcagaaagatacaaatccgaattctgtggcaggaaacgccacaaacaggccttggtcctccacctttcaggtgtatatctggcaggcagagcctggcactgggtactccccaactgagatgacccaatattgatgctagagcttcgaataaagtggcattcccatgggggtgacccctggtgtttctctagggaagtattccacctccttgactatgcaccaactgaggggaatgtgggcaactccaacatccatcatggccagcctcacagaactctctagaacttgtgcctgctttgaagataggatccgggctggggtctggagatcactttgcagcactaatattgagcaaatgagaactactatcattagttaacttcccaggcagaactcattggccgagcaaggctatatcctagactttcagagacagctctgggctgggctggctgtcatgacataatagctgggagatcttgcacggccaagtacagggctgtgttgttctgatggctgttggaatctggattttggaactgaaagaattggctagattgctttaggtatactccgtcctgctgctaactaagtagcagtgacctttaactcccttcatccacagcctctcccgttaatctcaagccccaccatacaacccaccatcatccaggagcaaaagggacaggcagagggtgaagcctacaaagatgacaaacatcagagctcacctagtccaaccctcaaatcttcaggtgttaaaacaaagagcctgaacatctgcagatcacgtacagagtcagggcctttcccctaaacccctttcactcattcatttattcactcagtattgactaaggccacctagtgccaggtgccaggtgccagggagcaaccagtgaacaagacagacgtaccttcataaagcctgtgtctagcagggaaatctgagaagaaaatgacaagtcttatgaatgttacaaagagggaaatatgagtgctgccagagccgatgggacgggccagggaagggctccccaggggatatttacacgtgcaaattaatgatgaggattggctgtgtgaaggtggggagaggagctctctaggcaggaggaacagcacatgcaaagcccttaattgggggagagggtagttccatgcaaagaactaaagggagtctgggatggtggcagccaaggaagagggctctttccacatcgtggacggccttggagcctcagcctaaggatggtgagcaactcgggagtttttaggcaagatgaggtttttgttttgttttgttttgtttttttgagacagagtctcgctctgttgcccaggctggagtgcagtggcataatctcagctcactacaacctctgcctcccgggttcaagcaattctcctgcctcagcctcctgagtagctgggactacaggcgcacgccaccatgcccagctaagttttatattttttagtagacacaggatttcgccatgttggccaggctgctcttgaactcctgaccccagatgatccgcctgcctcggcctcccaaagtgctgggattacaggcgtgagccaccgcccccgaccgaagtttgtattttttaaaaggtcacattgtctgcttttgaggggatacactgggagagatgcagggagaccagcttttcggaggagtgggggattgggtgtggcattccaggcaagcgatggtgacttcaccaagaggcaacagctgaacagaagcagagtcagcatcaccctgagaactggctggggtgggccgccattgaaggaggacaggaaacctggagcagagctgccccagctgagcacagcccgagctccccagcccacctgccgatgcgcgagaaagtccacagagtcccctagcctggtctagcttaggtcagtcatattcagccacccctcagacatgtgctaaataattaactgttacattagtcactgagtttggaggtagattattatgaagtaacagcaaactaatacagagagcatctctgtattaatgtattaatgtattactttctcagggccacatagcaaaccaaagagtaggcagacaaacggccaaaactgcaggtctcctgtatggggacatttccacaaatatcttcagaatactggtcactccctttagagaacaagtcctggagaaacagtcgaaacagtcatcacgtgtcctacagatggaagggctggccaaccagaaagaaaagaaaaagtcgagtcagcagaacttggtgattgattggatgaggagaccaggcctgagggctgcagggagtctaggaggagtctcaggagcagggcctgaggaactaagaaggggctctggctgagaccagacaggagcagccactgtctggaattttgtccccactgctgacttcgaacaacctcaacttcaaacagaaagcccagactcgatgaatttatcttttcttcaaagtagagaaagggtagctcttttcttcccaggaaattgtttatccatttaataatttttaaaaatcactggagttgggtgtggtggctcatacctggtaatctcagcactttgagaggccgaagtgggcagatcacttgagctcaggagttcgagaccagcctgggcaacatagtgaaaccctgtctatacagaaaatacaaaaattagctgggtgtggtggcatgcaactgttgtcctagctactctggagcctgaggtgggaggatcacttgagcctggaaggcggaggttgcagtgagccatgatcgcaccactgcactccagcctggatgacagagtgataccctgtctaaaaaaaaaaaaataactgggataaaacaactcgaaagacccttataaagattttacccgtaactctgtagagcaaataacttcctgctttaggcaaagctctttgtgtgtaagttcgattggaagaggagggctggtggggggagattctctactttggtcatgagattaacattaaaagtttgaggaaggttgctctatatattggctgcctgtttctaagactgaaaataaaagcacagtaaaatatcaacaagtatacagaaaatatacatttgtagaaaattagcttttttttttttttttgctaagtacttcatataaactagtatttgctttctagattaaagaatatctcctccaggtgtggtggctcacacctgtaatcccagcactttgggaagccgaggtggatggaccacgatgtcaggagttcaagaccagcctggccaacatggtgaaaccccatctctcctaaagatacaaaaaaaattagccaggcgtggcagtgggcgcctgtaatcccagctactcaggagactgaggcagagaattgcttgaagccagaggcagaggttgcaatgagccgggatcacgccactgaactccagcctgggtgacagagtgagactcttgtctcaaaaaaaaaaaaaaaaaaaaaaatatctcagatattgaagcgaacctataaataacagcagaagctgaagaaaagataacggatcaaaaagcagaaggagaaagcttccctgtccccaaggacctgcccacagtcgtggatgagaagtcccttgataagtagggtctgaacccacgtgatcaaatgttagctctgtgaacctgtgccagtggctgtgtgtcagtagcccagggtgattcagaagctccatgaagcagccatctttcctggatctctggaatgtacacatttgctgagatcacaaagatgaagctggcagaacccgagtggatattcattattacgaacagaagaacagccaacaggagccgtgccatgtgcaaccccgagttgacagatgcctccccgcttcttctgtgtttgccagttgttacaaaatgatctagagaaaaactggaacttgatggagaaagcaatggcttacgattcagcaggctttcttggagagtttacctaaagtctatgtggacggtggctcagctcacctctgagaacaatacgatcttcacttttcaatctttctgcagctctaattagtgccacagggaaccatggatgaaaatggcttctcgtgttgatatccatttggggaataggatggatgcagctgcttttgctcaagggcagagttttgacttcaaagaccctgaagagaacccagaaggaaaactctcagaggtcaatggactatattctttacctgggggatcgttgacaccacagcagtaaaagcgaagtcagtgtcgtgctgtcttgaaattagatgacaagaatgactgacaccaatagagctggaactgcacttggagcctgagtagccggtctcaggctaaccacacctgtgctgaccacagcgtggcccgtgttgttcatgaggcattctggctgtacctccacagggatgcaagacttccagtgagaggctgcttctgcaagaaaatacctgcctagaaatggtccgctttctcttcctaataaagtgataagctttcttagtccaa

SEQ ID NO: 150113 - DNA, 941 bp, Homo sapiens
  Payload ID: 9640
  Gene Symbol: LYRM4
  Gene Name: LYR motif containing 4
  ENST ID: ENST00000480566
  CDS Start-End: 10-222
ctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggcataaagtccatagtcattgtctgccaccagatttgatggtgtatgaattatatctccataaagctgttaagagacatcaggaagagaccagagtttcttctgtgcggagccctctgccacaggaaaggaaggaagtctacccagtcttcctacaggcgctgctccttggggcggtttagcatgtcattaccacagactgtggctaggacctgtgggactcatttgtaaatgccaccttctttgacaacacctgggattgttgaaatggaagtaatcgattactagaagccattaattgaaagctgtgtgccaggcattgtagtaagacattataaataccatctaacttatgtaaaattgacattatcccattctgtaggtaaggaaactgagactacagggttaggtgaaacccaaggtttcggagccagtgattggcagagcaggtgtttaaaccaggtttgtcttgggacaaaccccaggctcttaagtactacattatcgtgtcttcccgcttctccaccctcaacccagccccagtcaaaaaggcagcaggaaaggggacaagttatcatttagaagaatactgatttggttttaaaagtattgaatagaatgaccaaatgatctagtgattccatttctcagtatataccccagagaactgaaagcagggactcaaaaggatacttgcccaccagtgttcagagcagtattattcac

SEQ ID NO: 150114 - DNA, 1401 bp, Homo sapiens
  Payload ID: 9640
  Gene Symbol: LYRM4
  Gene Name: LYR motif containing 4
  ENST ID: ENST00000464010
  CDS Start-End: 1-291
atggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtagctgagcaaggcacagccgccaggaggaagtcggggaacagcagccggagcctggggaagccctgcacaagttggccttgaggaaaccacctgacagacgtttgctcttcctcacagagctggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgct

SEQ ID NO: 150115 - DNA, 592 bp, Homo sapiens
  Payload ID: 9640
  Gene Symbol: LYRM4
  Gene Name: LYR motif containing 4
  ENST ID: ENST00000500576
  CDS Start-End: 5-397
caaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacagatggactctcactctgtcgcccaggctggagtgcattggaacgatctcagctcactacaacctctgcctccctggttcaagcaattctcctgcctcagcctcccgagtagctgggattataggcgcacgccaccacgcctggctaatttttgtattcttagtagagatgtgatttcactgtattagtcaggctggtctcgaagtcctgacctcaagtgatccacctgcctcagcctcccaaagtgctgggattacaggtgtgaaccactgtgcccggcagacaattataatttttatgtagttacatttcacttcattgtctttgaattttgtgtcatgctgaattcccactccaagacaataaaaattctcttgcatttc

SEQ ID NO: 150116 - DNA, 1134 bp, Homo sapiens
  Payload ID: 9641
  Gene Symbol: LYRM5
  Gene Name: LYR motif containing 5
  Uniprot ID: Q6IPR1
  ENST ID: ENST00000381356
  CDS Start-End: 160-432
ggccggcgccccgccccctttactgacaggttgcccacctcccccaacgccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcct

SEQ ID NO: 150117 - DNA, 833 bp, Homo sapiens
  Payload ID: 9641
  Gene Symbol: LYRM5
  Gene Name: LYR motif containing 5
  ENST ID: ENST00000556927
  CDS Start-End: 209-475
gcttcgcagtagacggacagaggagtcgtagcggtcgaggcttttgcggctccggcgtgccggaaagaaaacgtcaattatgacagcaggtaattttatcggaagtgtttataactatatcccagtacgtggaacgaaaaagttatcaagaaatatttattgaatgtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaata

SEQ ID NO: 150118 - DNA, 1259 bp, Homo sapiens
  Payload ID: 9641
  Gene Symbol: LYRM5
  Gene Name: LYR motif containing 5
  ENST ID: ENST00000557540
  CDS Start-End: 170-436
ggccggcgccccgccccctttactgacaggttgcccacctcccccaacgccaccccgcttcgcagtagacggacagaggagtcgtagcggtcgaggcttttgcggctccggcgtgccggaaagtgcgtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcctatttttttgtcataaaggcagatttgttttgcatctacttctaaatatggttttaagtttaagcaaacacgcctttacataatatccacagcaccttttagaaataaaggatacttctaac

SEQ ID NO: 150119 - DNA, 783 bp, Homo sapiens
  Payload ID: 9641
  Gene Symbol: LYRM5
  Gene Name: LYR motif containing 5
  ENST ID: ENST00000555711
  CDS Start-End: 121-237
aacgccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaataaatatataatctttctttttgaagctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataattt

SEQ ID NO: 150120 - DNA, 1086 bp, Homo sapiens
  Payload ID: 9641
  Gene Symbol: LYRM5
  Gene Name: LYR motif containing 5
  ENST ID: ENST00000556885
  CDS Start-End: 117-383
ccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatccta

SEQ ID NO: 150121 - DNA, 429 bp, Homo sapiens
  Payload ID: 9641
  Gene Symbol: LYRM5
  Gene Name: LYR motif containing 5
  ENST ID: ENST00000554266
  CDS Start-End: 220-345
ccgcttcgcagtagacggacagaggagtcgtagcggtcgaggcttttgcggctccggcgtgccggaaagaaaacgtcaattatgacagcaggtaattttatcggaagtgtttataactatatcccagtacgtggaacgaaaaagttatcaagaaatatttattgaatgtaaaaaaggtatgttatgcataaaagtggataatttacatgataaatgaaaatggccaattctttaagaggagaagtactaaaactttataaaaatgtaagtaattatgttgccaattttataaaaatgttattatatgacatggattgtttagaaatatataatctttctttttgaagctgctgtatcttggacgagactatccaaaaggagcagactattttaaaaagcgtttgaagaacattttccttaaaaacaaag

SEQ ID NO: 150122 - DNA, 708 bp, Homo sapiens
  Payload ID: 9641
  Gene Symbol: LYRM5
  Gene Name: LYR motif containing 5
  ENST ID: ENST00000553788
  CDS Start-End: 213-326
gcagtagacggacagaggagtcgtagcggtcgaggcttttgcggctccggcgtgccggaaagaaaacgtcaattatgacagcaggtaattttatcggaagtgtttataactatatcccagtacgtggaacgaaaaagttatcaagaaatatttattgaatgtaaaaaaggtatgttatgcataaaagtggataatttacatgataaatgaaaatggccaattctttaagaggagaagtactaaaactttataaaaataaaaaatataatattttggggagagtgaccatgactaatagcagtggaaaggagacaaaacctttgtgaacagtgtaactttacattcatcagggatgacaaactataggacatgatgcctagaagaatcatcatcaggaagcccataaatttgtgttccctcaatgtttcagtaaaaaccaattagaaggtctcaactgaaattagtaattaatccatttatgtgactagataaaacacagaatagggatgattcaaaagcttcattaatttgtttcacaccaacattcacaattggtaagaaaaataagaagtaatcaactgcatgcaccaaaagccccaagacagaaatcttaggtattcagtttctttttcacaggcattgctagttcaaaaaccaaaactctgggaatactggcacttagaggaaaaaaaaacttccactgtcatt

SEQ ID NO: 150123 - DNA, 233 bp, Homo sapiens
  Payload ID: 9641
  Gene Symbol: LYRM5
  Gene Name: LYR motif containing 5
  ENST ID: ENST00000556198
  CDS Start-End: 132-233
tgggaggcctgggcctctgcggtttaatccagcagggggatggggctcattccgcaatttaaagagagaaataagttggctccagagggtatgttatgcataaaagtggataatttacatgataaatgaaaatggccaattctttaagaggagaagtactaaaactttataaaaatctgctgtatcttggacgagactatccaaaaggagcagactattttaaaaagcgtttg

SEQ ID NO: 150124 - DNA, 838 bp, Homo sapiens
  Payload ID: 9641
  Gene Symbol: LYRM5
  Gene Name: LYR motif containing 5
  ENST ID: ENST00000556351
  CDS Start-End: 218-484
gcttcgcagtagacggacagaggagtcgtagcggtcgaggcttttgcggctccggcgtgccggaaagaaaacgtcaattatgacagcaggtaattttatcggaagtgtttataactatatcccagtacgtggaacgaaaaagttatcaagaaatatttattgaatgtaaaaaaggtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacattt

SEQ ID NO: 150125 - DNA, 874 bp, Homo sapiens
  Payload ID: 9641
  Gene Symbol: LYRM5
  Gene Name: LYR motif containing 5
  ENST ID: ENST00000556402
  CDS Start-End: 105-230
gcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatgtaagtaattatgttgccaattttataaaaatgttattatatgacatggattgtttagaaatatataatctttctttttgaagctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttc

SEQ ID NO: 150126 - DNA, 6351 bp, Homo sapiens
  Payload ID: 9642
  Gene Symbol: LYRM7
  Gene Name: LYR motif containing 7
  Uniprot ID: Q5U5X0
  ENST ID: ENST00000379380
  CDS Start-End: 212-526
agcaaacgcctttagcaaacgcccgtttagcaaacgcctcctccgtcctttggaggagggcggggctaaaagggagatgctgcctagtgattcgttgtggcgcattagtaacgcgactacagggggctggaaacagttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagcagccagaataaagataaatgaagaattcaaaaataataaaagtgaaacttcttctaagaaaatagaagagctaatgaaaataggttctgatgttgaattattactcagaacatctgttatacaaggtattcacacagaccacaatacactgaaactggtccctaggaaagaccttcttgtagaaaatgtgccatattgtgatgcaccaactcagaagcaatgagttttctagaatacaacaagtctttgtactttttaactttaaaatctacaactctggcaaaagtcctggaaatgcagacattttccctgaactggcatattgaaaatgaatgaattacagaatagcttcatatttaaatttcatgttaaaaggtcattactgagaactaaagaacataattaagtatttctaaaggaaattagataagaaaacatttcattttcattgaaaatcaaatttcataaagcaaagtaaatgcttagggagatatattcaatctttgaccttgatgagtatttgatcttaccatagctatttgagaatgtggtgcttttacaaattggtgagttttcctgccatgtgaaatgcaattattacatttaaattgttagattaaaatgatatttagtcctgaaaaatattaaattggtcaaaaaaatcacagtgtatgccagctctctacagaaagtggcctttgttttctaaagcactgggattatttctgtagctaatatataattgtacagtttctttttagagatagagagtatctctgtgttcttatgaagacattttttatcagttttctgaaaatagatgaataaaatattatagtcacctagggtcactatggaataaagaaatcctagtttaaagaggaaatagtggcccttgatcaaactatttaatatggccttagtagaattagctgtatttagacaaagttagactttagtgtgaaatgtaatcggtggctacattctcatcgttttaattaatgaaacttaaatggcttctcttcttccacatgtcctgtccttgacaagatgggcagtatcacaaaaggtcctggcattctaccatctaacactaggaactgtaaaatactgtttaatattcttcttgtttctcttttatctgtgtatctttgccattctattttctcagtgaatagtatgttttctcccattcactgataaattctctcatttgatgatgatacagggtttttaatttttgcaagattctcaatgcaagcattgttatgtatctagaaattatacctagagaaaaatgaaagtcgtttcaaatttgaaatttgcccttttaagagaatgctgaatgtcatcgcagtatataatcactatataaatgtgctgacttacagttattttagtgtctatatgacatattttgaggaaagttggctgacgttatttaaatttaatatatattctatattttagtgttattgaatattttatcactgagcttttttctttaacctgaattccctgttccatttttcattcatattaatttaaataactccagatttctttcttatagtcattattagtagcagatgagattaataattcacatgtttattaaagatagtggcttagaaattttaagatatattgatataggcccgggcgctgtggctcacacctgtaatcccgcactttgggaggctgaggcgggcagatcacaaggtcaggagttcgagaccagcctggccaatgtggtgaaaccccatctctactaaaaacacaaaaattagccaggtatggtggcgggcgcctgtagtcccagctactcgggaggctgaggcaggaaaatcacttgaacccgggaggtggaggttgcagtgaactgagattgtgccactgcactccagcctgggggacagagtgagactctgtctcaaaaaaaaaaaagaaaaaaaaaggaaaaaggaaaaaaaaaagatatattgatacagataggtagatatgatattgtactttcatgccataagactacacaataaagttcctgaaagttcctggctgggcgcagtggctcacgcctgtaatcccagcactttgggaggccgaggcaggcagatcacctgaggtcaggagttctagaccagcctgaccaacatggggaaaccctgtctctactaaaaaaaatacagaattagccaggtgtggtggcacatgtctgtaatcccagctactcgggagactgaggcaggagaattgcttgaacccaggagacggaggttgcagtgagccgagatcgcaccattgcactccagcctaggcaacaagagtgaaactccgtctcaaaaataaataaataaataaagttcctgtgaagtatataaacatgtcaacaacaggcttgactgtcacaaaattctgaaagatgtcgcactctattcttatatagcatatgctaatttatttatttattttttgagattgagttctgctgtgtcacccaggttggagtgcagtggcatggtcatggtccactaaagccttgacccctggggctcagcagttatgccaactaagcctcccaaatagctgagactagaggtatgcgccaccacacctagctattttttttatttttagtaaggacaaggtctcattatgttggccaggctggtctcaaattcctgagctcagttgatcctcccacctcagcctcccaaagtgctgggattacaggtgtaagccactgcaccctgcctattcttataatcatatatttatatttcaaatggattttaactggttatttaatagtttaattagataaagtaattcatggctgggtgtggtggctcacgcctgtaatcccagcactttggcaggctgaggcaggtggattacctgaggtcggaagttcgagaccagcccaaccaacgtggagaaaccccatctctattaaaaatgcaaaattagcaggacatggtgatacacacctgtaatcccagctagtcaggaggctgaggcaggagaattacttgagccagggaagcagaggttgtggtgagctaagattgtgccactgcactccagcctgagagaacaagactccgtctcaaaaaaagaaaaaaagaaaacttttttacacatgggtatctcaccatgttgcccaggctggagtgcagtagctattcataggcacagtcatagcacactgcagcctagaatttctgacctcaagcaatcatcctgcctcagcctcctaagtagctaggactacaggtgcataccaccataaccagctttaattaaatgttttttatttggttattttttttaagttttctgtattcacacaaggggttgcccaaatataattttgctttgactattgagatctagtgaaagtggggtatatgaattctaattgcaaatatccaggctcagaggcccagcaggactttctaacacaatcttttagcggaagttagaaatggtatatagcaggagagtcagatttgagaagcatatgtagattcgaagctgggggaatatggcaggtagtttgtacaacatctaattcagaacattaaaattaagattttagtcaaactgtgtttaagttagttcttattttcctgtagatgcatctcacagcatcagtacaataccaaaaaagcacacaagaataagaatatgtggaatttctatacctattgacaaagcacataatttaaccataaacacaaagccataggtcaacaaagaaatgaagattccagttctgaaggtgagttttctgaagccaaagtggatacatgcaaaattaatatagttttactgtatatcagttgtcaccaatcagaaatggaaaacagatcctatttataattgcaaacaaaactgtaaaatagactttttaaagtctgggaatagacttctaaaataagctataacacttaaaaaggagagatatactatgttcctagataggacaattgaaaattctggagatgacagtttttcaaaaatctattgaggccaggtgcagtggcccatgcctgtagttccagtactttgggaggcctaggtgggtggatcacctgaggttgggagtttgagaccagcctgaccaacatggagaaaccccgtctctactaaaaatacaaaattagccaggcgtggtggtgcatgcctgtaatcccagctactcgggaggctgaggcgtgagaatcgcttgaacccggtaggcagatgttgcagtgagccgagatcgcaccattgcactccagcctaggcaacaagagcgaaactccatctcaaaaatagaaaaaacatttatcgaaatcccaacaagttgacaaatatatccacataaaaatataaaacttctgtattctgtgaaagctactataaataaagtttagagaaagttatttgccacctatgtcatgattgaaatagttaattgatcctgtgaatcagttagcaaaacataactcaatggaaagataggcaaatgatacaaataagaaattcacaaaagaagaaatactaagtctctagtgatgagagaaatgtaaattaaaatgaaacatgtttgttcatcaagttgtcacaagttagacaatcatatccaatatttttaaaggttgtaagactataaggaaatagccactgtcatatcatttttaaaggaatataaattatagggccttttgtttctttgggttttttttttttagagacaagatctctccgtgttgtctaggctggactcaaacttctggactcaagcaatcctcgcaacatcattaatagctgagagtagagacttgagccaccacacctgactatagggcctttttgaaaggaaaattgacatcatcaaaattttaaatatattcagtctatttctcaaaaactcaaagaatactaataaatgtgtactcaggtatatgtacagaaattgctgtaacattataattttaaacaatttaaaacagactgagtttccaaagttagggtacaatgaaagaaaaggtggcttatttatactctggaatattttccaagagttgaaaaggatgaggatacacacacacacacacacacacacacacacacacacacacacacacagtttgggtatccctaatccagaaattcaaatgctccaaagtccaaaactttctgacccaccaacatgactgatgctcaaaggaaatggccactggaagatttcagattttcagatttggagtgctcaaccagtaagtatataatgcaaataatccaaaatacaaaaaaaaaaaaaaagaaatctgaaacacttctgatcccaagcatttcagaaaacggatgttcatttgtgtgtgtgtgtgtgtgtaagcaggtgttgctagaaattcacttatatacaagaaaactttttgtgtacatatttgcatatatatgtacaaatgggtagaaacgatacatgattaatcttaatcgggaaggaaaagagatttagggaaggaagcagtaagtgagaacttttattctatttactcctgcacgtttaaatattgtttacagtgagtatatcaacatgtaagtgttaaaagacaataagctactagtgatttttaatataaaattaactataaaatattttaaatattagcaaataatatagcacactcatgaacctaattcccacatttgatagttgttacattttgccatgtttgtttaaaggtctaagtcataaaatcttataaagctaaaccccacccttctctttctcctctctctccaggataattactgttttatagtttgtggatatcattcccttacttgtgtttatacttttaccaagtgtgtatgtattcaaaaaacagttgttttgtgattttaaaatgtaaatgaatggcgttatgctccatgtattctgcaacttttcatcatacattaggttttggcgatttagccataatttggcatgaattcaggtcttttaagttttattccattgtaagaataaacaagtttgttcattcatgtctc

SEQ ID NO: 150127 - DNA, 604 bp, Homo sapiens
  Payload ID: 9642
  Gene Symbol: LYRM7
  Gene Name: LYR motif containing 7
  ENST ID: ENST00000510516
  CDS Start-End: 78-239
agttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagaactggtccctaggaaagaccttcttgtagaaaatgtgccatattgtgatgcaccaactcagaagcaatgagttttctagaatacaacaagtctttgtactttttaactttaaaatctacaactctggcaaaagtcctggaaatgcagacattttccctgaactggcatattgaaaatgaatgaattacagaatagcttcatatttaaatttcatgttaaaaggtcattactgagaactaaagaacataattaagtatttctaaaggaaattagataagaaaacatttcattttcattgaaaatcaaatttcataaagcaaagtaaatgcttagggagatatattcaatctttgaccttgatgagtatttgatcttaccatagctatttgagaatgtggtgcttttacaaattggtgagttttcctgccatgtgaa

SEQ ID NO: 150128 - DNA, 317 bp, Homo sapiens
  Payload ID: 9642
  Gene Symbol: LYRM7
  Gene Name: LYR motif containing 7
  ENST ID: ENST00000507584
  CDS Start-End: 33-224
ctctggaggtagcggccgcggtgaggagagccatgggacgggcagtcaaggttttacagctctttaaaacactgcacaggaccagacaacaagtttttaaaaatgatgccagagcattagaagcagccagaataaagataaatgaagaattcaaaaataataaaagtgaaacttcttctaagaaaatagaagagaactggtccctaggaaagaccttcttgtagaaaatgtgccatattgtgatgcaccaactcagaagcaatgagttttctagaatacaacaagtctttgtactttttaactttaaaatctacaac

SEQ ID NO: 150129 - DNA, 501 bp, Homo sapiens
  Payload ID: 9643
  Gene Symbol: LYRM9
  Gene Name: LYR motif containing 9
  Uniprot ID: A8MSI8
  ENST ID: ENST00000379102
  CDS Start-End: 86-322
agtccccggggcgcaggcgcactcgtcgccgcggcggcgtccggggctggcgttcccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagagccattggccttgttggctgaaagccagaaatcaggggagaagctgaccttgctccagaggctcctcttgccgcggccatgttgctagcatcctt

SEQ ID NO: 150130 - DNA, 1685 bp, Homo sapiens
  Payload ID: 9643
  Gene Symbol: LYRM9
  Gene Name: LYR motif containing 9
  Uniprot ID: A8MSI8
  ENST ID: ENST00000379103
  CDS Start-End: 290-526
gaactaatacagtatagtttcttgttcttcagaagcttacagtcagcaaggaacagaaagccaaataaagtaggaaagggctcaggcctgtaggcattctcccctctgtggcttggtgccctcgccagaccatggctgatgtcagagctggtttcctagtgattgcccctcagggtcttcctgcttttctaccctaccctgccggtgagggacacctactcatgcaccacttgaagttgagttccagaaagaagacgccagggatgaggctggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaatataaaaaacaaaactgagagctccgagggtgagccttcctggcctctggaagttgagaggcccctcttctggagctcagcagcagcagctggtttggaagagccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaagctcgtgtgtcttctcaactgataaaccatacgttccctaagca

SEQ ID NO: 150131 - DNA, 432 bp, Homo sapiens
  Payload ID: 9643
  Gene Symbol: LYRM9
  Gene Name: LYR motif containing 9
  ENST ID: ENST00000503642
  CDS Start-End: 131-391
ctgggttcacctgccataggttcttgacttcaggacagtttcctgctggctttagtttcctctggtaacttgggaatcaattgacatctatggaacttctgttatggttcagggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaagtaggtgcttggcccctgggctctgcctgcgagctggggtgatgatggctgtgatccccatgaccactagaggccactcctgc

SEQ ID NO: 150132 - DNA, 807 bp, Homo sapiens
  Payload ID: 9643
  Gene Symbol: LYRM9
  Gene Name: LYR motif containing 9
  ENST ID: ENST00000508862
  CDS Start-End: 86-364
agtccccggggcgcaggcgcactcgtcgccgcggcggcgtccggggctggcgttcccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaattgagaatggtccctgtggaggaggccaccagccagctgcttccctcctccagaagctgaaagtataaaaaacaaaactgagagctccgagggtgagccttcctggcctctggaagttgagaggcccctcttctggagctcagcagcagcagctggtttggaagagccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatccc

SEQ ID NO: 150133 - DNA, 460 bp, Homo sapiens
  Payload ID: 9643
  Gene Symbol: LYRM9
  Gene Name: LYR motif containing 9
  ENST ID: ENST00000508816
  CDS Start-End: 378-460
gattcatgcttctcagactttaaaatgtgcctgcaaatctcctggcatccttgttaaaatgcaggtttgatctggtgggtctttggggtggggcccaagactacatttgtgatgagctcccgatgctgtgggttttgctggttcaggagcacactttgaatttcaaggctcaggcctgtaggcattctcccctctgtggcttggtgccctcgccagaccatggctgatgtcagagctggtttcctagtgattgcccctcagggtcttcctgcttttctaccctaccctgccggtgagggacacctactcatgcaccacttgaagttgagttccagaaagaagacgccagggatgaggctggacagagggtctcacggatggccccgctgccaggagcagaactggttcggaggccactgcagctctaccgatacttgctgcgctgttgccagcagctgcc

SEQ ID NO: 150134 - DNA, 2196 bp, Homo sapiens
  Payload ID: 9643
  Gene Symbol: LYRM9
  Gene Name: LYR motif containing 9
  ENST ID: ENST00000460380
  CDS Start-End: 62-322
gtcgccgcggcggcgtccggggctggcgttcccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaaccctgagagaatccagcagattattaaaagagccattgaagatgctgactggatcatgaacaaagtaggtgcttggcccctgggctctgcctgcgagctggggtgatgatggctgtgatccccatgaccactagaggccactcctgccccacagttgagaatggtccctgtggaggaggccaccagccagctgcttccctcctccagaagctgaaaggtgaagacaaatcccttctggttgcatttatattctgcaagtggggaggggctctcactcttcatccttaaaggcaaatttctgcccaacagtgctgatcgagctgagagggggcagcaggaagaaggagggaaagctatagtgccagagccggcggtggcactgtgatgccgcagagagggaagctgtcctggcgggggactccctgtctctggggggtattcacactggggcagaattatggaggaaacattcagtatgttttggtggaggaagggagtgagtcaggaatgtagactggcgtcttggcccttagatgctggtattagaaggacctagagagttggagtgtgaccatacctccctgtccttctaactcactctccagagtgagttatcactatcctccctccccagccctgtcagcttcctttttcactaaagaagaaagggagtccaggcatgaactagagatttggctgcccagtgcctcctgcttgggtttcaccacctccaagaagcccctgcaggaggcaggtgaggtccagatgatggaggcctgagatttctccagagtcctcctgcccctgttggcttccctcctccacttcgaatctctctgtcttgcagtataaaaaacaaaactgagagctccgagggtgagccttcctggcctctggaagttgagaggcccctcttctggagctcagcagcagcagctggtttggaagagccattggccttgttggctgaaagccagaaatcaggggagaagctgaccttgctccagaggctcctcttgccgcggccatgttgctagcatcctttatgtttgcacttccagccacttacgatgtgaaatttggggagaatgtagtatttttttgcttcttttgtgtgttttttatttttgtgtttttgttcttttacttttctctgaaagtgattcatttattctggagatctctttatcattctctgagtcccagagcagatgtcccctcaggtagcaacctgtacagaagaaagcacgtgggttttagaaccagacagatctggatttgaatcccagatgcaataagatgaaggtgaagtgcctcacacaggatgtggcacatgacagtgcctgaagggctcccttcaaggaagccgtcctgccccgccccctcctctgctcctgcagcgccctgcacagctctgctccccgcatgcaccgcatcgggtctcagttttttgtttgcgagcttgccctgtccctgcttgtagcccctgagccctcacagttgtcacacacccagcagtctgccaaggagctgcttttcctgactactgtctctccatgcctagggaagtcaaagccctgggccttgccttcagggagttgacagtgtccttgaagtggtgaagtgcccaccacatgaaccaaggagagacgccaaagcagctgccatggactctggcctgtccaagcctctgtgcacctgcagtctctttccactggcacttccctgctttgctaccatcgtggaagaatggaagggagggggagaaggtgggtgggctcagggagaacggccagagtggccagaagatgcagagagaagccccactgggatctgagtattccccaagggcactcagccacagggatgaactagtgtttgtttgtatccttgcagttatgtgacttaaagtgactcagagatatctatgtatgcgagtgtactccgctggcaatgaagtaaatatatcaatttgtggaa

SEQ ID NO: 150135 - DNA, 3033 bp, Homo sapiens
  Payload ID: 9644
  Gene Symbol: KDM1A
  Gene Name: lysine (K)-specific demethylase 1A
  Uniprot ID: O60341
  ENST ID: ENST00000356634
  CDS Start-End: 150-2708
ggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattg

SEQ ID NO: 150136 - DNA, 3059 bp, Homo sapiens
  Payload ID: 9644
  Gene Symbol: KDM1A
  Gene Name: lysine (K)-specific demethylase 1A
  Uniprot ID: O60341
  ENST ID: ENST00000400181
  CDS Start-End: 105-2735
ggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgacactgtcaaggttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaatt

SEQ ID NO: 150137 - DNA, 905 bp, Homo sapiens
  Payload ID: 9644
  Gene Symbol: KDM1A
  Gene Name: lysine (K)-specific demethylase 1A
  ENST ID: ENST00000494920
  CDS Start-End: 1-905
gactttgagttcactggcagccacctgacagtaaggaatggctactcgtgtgtgcctgtggctttagcagaaggcctagacattaaactgaatacagcagtgcgacaggttcgctacacggcttcagtcttttcccacccaacctctgcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtcccc

SEQ ID NO: 150138 - DNA, 568 bp, Homo sapiens
  Payload ID: 9644
  Gene Symbol: KDM1A
  Gene Name: lysine (K)-specific demethylase 1A
  ENST ID: ENST00000465864
  CDS Start-End: 1-568
gaatatgatgaattagctgaaacacaaggaaagctagaagaaaaacttcaggagttggaagcgaatcccccaagtcctttgttcttttgcagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtca

SEQ ID NO: 150139 - DNA, 3811 bp, Homo sapiens
  Payload ID: 9645
  Gene Symbol: KDM1B
  Gene Name: lysine (K)-specific demethylase 1B
  Uniprot ID: Q8NB78
  ENST ID: ENST00000297792
  CDS Start-End: 178-1950
gcggccgagaagaggctggggctcgcggcgcggctgcagccgtcctgtgcgcgcggcgcgcggctccggagaggcgcccgcagtccagggcggcgcgcaccgcctcgctggcgctcagagcggtgccttttccccgagactcccggcacctcttcagcgcaaagattatttaatgtaatggcaactccacgggggaggacaaagaaaaaagcatcttttgatcattctccggatagccttcctttgaggagctccggtaggcaggcgaagaagaaagcaacagagacaacagatgaggatgaagatggtggctcagagaagaagtacaggaaatgtgaaaaggcaggctgtacggcaacatgtcctgtgtgctttgcaagtgcttctgaaagatgtgccaaaaatggctacacctcccgatggtatcatctctcctgtggggaacatttctgtaatgaatgctttgaccattactacagaagccataaggatggatatgacaaatatactacatggaaaaaaatatggactagcaatggcaaaaccgaacctagtcccaaagctttcatggcagaccagcaactcccctactgggttcagtgtacaaaacctgagtgtagaaaatggaggcagcttaccaaggaaatccagcttactccacagatagccaagacttatcgatgcggtatgaaaccaaatactgctattaagcctgagacctcagatcattgttccctcccagaggatctagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaagtatctgctcgctcgtgggaccacaatgaattctttgcccagtttgctggtgaccacactctgctaactcccgggtactcggtgataattgaaaaactggcagaagggcttgacattcaactcaaatctccagtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaaggcgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacagcacaaactccagttgacagtaaaatgaagcttctaggtattttgtattgtacatatttcctcctactgggtgttcaaaagaaatttaaattcaagtaccttttgtgataaaatgttttagatttgtgcacccattggcaaaacaggaaagtttccagataggtattgtatcattgagaatgcagcacagatagtgtgggcttcacactatagacacagaatatagctttttcttaaagccaaatttgggtgataggacactttaaatatccttaattttggcaaccactagcaaaaaaacttgtcagaataatttaaccaagcccctctccacttcttttatttaaaagcactgattcaattgctaggaatatttttgcagatttttctttacagtattccataggcaggtccactggaaaactgcagaaaaatgtgagctctcctggtaaatagtatacattttataagctatattttaaaggcctaagaacatggcaagtatttacttttatcttttttttaaaaacactcatgacagaaaacagtttaataatatctcattctaaaataaaacactggttgcagggtcttcaggatgcctattttgccaagaaacttcagtatacaggttagaaatatgcttttgtttttgaacaataatatactggtttgctttaaagaagggactaaatatgactttaaagagacttcaaaatattgagtattttaaaaatttaaaagtaggtcagtttataacgagtaaatacctaacacaccaagaatgtgcagtgaacctcaggcatttaagacacctcccccaccgcccgccccccgccccccccaatcaaagtgtggtcccaaaacaagccaacagctgtatatctcaaaagttaacccaagacaactctgatatttaggttatttgttgagactcattggtactgactggcaagtattctgctttaaagtatcatgtattaaaatgtttagacagcatgtgttttaaagtgataaatgcaaaatgttaagtttgaaatggttaacagtaaattattatgttagtttccaggcacttgaactgtgctacaagtaggggaaaacctactttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttcacatgt

SEQ ID NO: 150140 - DNA, 2045 bp, Homo sapiens
  Payload ID: 9645
  Gene Symbol: KDM1B
  Gene Name: lysine (K)-specific demethylase 1B
  ENST ID: ENST00000449850
  CDS Start-End: 1-1922
attgttccctcccagaggatctaagagtattggaagtttccaaccattggtggtactctatgctcatcctacctcctttgctgaaagacagtgtggcagcgcccctgctgtctgcctactaccctgactgtgttggcatgagcccctcctgcaccagcacaaaccgcgccgctgccactggcaatgccagccctgggaagctggagcactccaaggctgccctctccgtgcacgttccaggcatgaaccgatacttccagcctttctaccagcccaatgagtgtggcaaagccctctgtgtgaggccggatgtgatggaactggatgagctctatgagtttccagagtattcccgagaccccaccatgtacctggctttgagaaacctcatcctcgcactgtggtatactaactgcaaagaagctcttactcctcagaaatgtattcctcacatcatcgtccggggtctcgtgcgtattcgatgcgttcaggaagtggagagaatactgtattttatgaccagaaaaggtctcatcaacactggagttctcagcgtgggagccgaccagtatcttctccctaaggactaccacaataaatcagtcatcattatcggggctggtccagcaggattagcagctgctaggcaactgcataactttggaattaaggtgactgtcctggaagccaaagacagaattggaggccgagtctgggatgataaatcttttaaaggcgtcacagtgggaagaggagctcagattgtcaatgggtgtattaacaacccagtagcattaatgtgtgaacaacttggcatcagcatgcataaatttggagaaagatgtgacttaattcaggaaggtggaagaataactgaccccactattgacaagcgcatggattttcattttaatgctctcttggatgttgtctctgagtggagaaaggataagactcagctccaagatgtccctttaggagaaaagatagaagaaatctacaaggcatttattaaggaatctggtatccaattcagtgagctggagggacaggtgcttcagttccatctcagtaacctggagtacgcctgtggcagcaaccttcaccaggtatctgctcgctcgtgggaccacaatgaattctttgcccagtttgctggtgaccacactctgctaactcccgggtactcggtgataattgaaaaactggcagaagggcttgacattcaactcaaatctccacaggtgcagtgtattgattattctggagatgaagtgcaggttaccactacagatggcacagggtattctgcacaaaaggtattagtcactgtaccactggctttactacagaaaggtgccattcagtttaatccaccgttgtcagagaagaagatgaaggctatcaacagcttaggcgcaggcatcattgaaaagattgccttgcaatttccgtatagattttgggacagtaaagtacaaggggctgacttttttggtcacgttcctcccagtgccagcaagcgagggctttttgccgtgttctatgacatggatccccagaagaagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaatcacatgttaaacctcagttttataagagggggaaaaaaccgtctctacatagtaaaactgaaatgtttctaa

SEQ ID NO: 150141 - DNA, 496 bp, Homo sapiens
  Payload ID: 9645
  Gene Symbol: KDM1B
  Gene Name: lysine (K)-specific demethylase 1B
  ENST ID: ENST00000546309
  CDS Start-End: 104-445
atgggcagggcggagcgagcgctgcggctaaagcgaaggcggggaccctacccatccctagtcctgtcggctcctcccaccccggaagaagcacagcgtgctgatgtctgtgattgccggggaggctgtcgcatccgtgaggaccctggatgacaaacaggtgctgcagcagtgcatggccacgctccgggagctgttcaaggagcaggaggtcccagatcccacaaagtattttgtcactcggtggagcacagacccatggatccagatggcatacagttttgtgaagacaggtggaagtggggaggcctacgatatcattgctgaagacattcaaggaaccgtctttttcgctggtgaggcaacaaacaggcatttcccacaaactgttacaggggcatatttgagtggcgttcgagaagcaagcaagattgcagcattttaagaattcggtggacccagctttcttctgtaccccagatggggaaatttgaat

SEQ ID NO: 150142 - DNA, 3666 bp, Homo sapiens
  Payload ID: 9646
  Gene Symbol: KDM2A
  Gene Name: lysine (K)-specific demethylase 2A
  ENST ID: ENST00000308783
  CDS Start-End: 222-3659
cagccctggagtggtttctttacagtaatttcaacagaagagtgagagatggaacccgaagaagaaaggattcgttacagccagagattggttcttggggtttttctctgtctgtgagtacttggtaaaaagttaaaccctaaagataaaaggcagcaaatagtgaccaaacgaatgtttttggcaaatacattggtgaaggcctccttcagcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacac

SEQ ID NO: 150143 - DNA, 6511 bp, Homo sapiens
  Payload ID: 9646
  Gene Symbol: KDM2A
  Gene Name: lysine (K)-specific demethylase 2A
  Uniprot ID: Q9Y2K7
  ENST ID: ENST00000398645
  CDS Start-End: 865-3213
gagtctgacgggttcaaaatggcggcggctgcttcagcggctcctcctgtgtgagggaaacaacacccctccccggcagcggcggcggcggcggcggctctcggagcaccttcccagcggctgggcccgtggccgctctgtctttcctgggcaggggacgctccgggaggaggggcaacgccagggggcccatcccccggaatccctcttctgcgactggggagtagccggggggctcgtcccgcagcgcggagccagacctgagggggagacgcgaggggagccagggcccccatcccggcgcgccgcgccgctcccgccctgtccgccccccggggccggggcccgcgttccggggggccggggcggcgcggggagcctcgggccggccggtctcagctgatcggccgctgctcccgcaggcgaccagcccctgctggccgagggcacggcgaggagggcgctccctgcggccggggccggcccggggctcgggcccgggctgctgaccgctggcctgggggaggcgggggcgccccgggctcggcgccgaggggtcgcgctcctctctcctgacgcctccgactcccggtctccaaagccagaagagaaggtttgattcagcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcactta

SEQ ID NO: 150144 - DNA, 6967 bp, Homo sapiens
  Payload ID: 9646
  Gene Symbol: KDM2A
  Gene Name: lysine (K)-specific demethylase 2A
  Uniprot ID: Q9Y2K7
  ENST ID: ENST00000529006
  CDS Start-End: 447-3935
gcaggcgaccagcccctgctggccgagggcacggcgaggagggcgctccctgcggccggggccggcccggggctcgggcccgggctgctgaccgctggcctgggggaggcgggggcgccccgggctcggcgccgaggggtcgcgctcctctctcctgacgcctccgactcccggtctccaaagccagaagagaaggtttgattcagcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaatagcctccaatgggaaatattttaatttaggttttgtttttgtttgggggtttttgtttttttaaaaaaataaaaaggctttaaaaacaaaaactaaa

SEQ ID NO: 150145 - DNA, 3651 bp, Homo sapiens
  Payload ID: 9646
  Gene Symbol: KDM2A
  Gene Name: lysine (K)-specific demethylase 2A
  Uniprot ID: Q9Y2K7
  ENST ID: ENST00000530342
  CDS Start-End: 162-2333
gttgcaaagcatttctgggagctgcatgtgggtgacgcagcagcattgttcgcaggcacaggaagccgcggctgagctgaagggctcgagaaggagcccagagcgctgcacgctgctccctctgggtagtctgaagggtcagagctggactgccctgccctatgtgctctgggagattccagaatattcaagtaaatccggattttcccagaggcagaatatctaactccttcaggagaacttccagtacagaaaacaaaacaaagacgctggggaaacttcaccaagagcctcggcagctccagagcgacgggaaacgaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaa

SEQ ID NO: 150146 - DNA, 5224 bp, Homo sapiens
  Payload ID: 9647
  Gene Symbol: KDM2B
  Gene Name: lysine (K)-specific demethylase 2B
  Uniprot ID: Q8NHM5
  ENST ID: ENST00000377069
  CDS Start-End: 408-4205
ccaacaacaaaacagcgatgccacggcgctaacggcgcccggtgcctcccgggctccctccccgccccatacctcctcgggccgccgcccccacccccccaagcccgggccgagagcccccccaaatagcccggccgcgggctccgagcgcgatcggcaacaatgtttacgttccggggattatgacgtcgacgcctccccccccccacaactgctgaaaatggtttcctaggactttgcaaacggatctgcctaagtgttggtgcaaaactttgtagatctcggctctggcttgctttatttatttattttttggtttgttttctttggtcttccctccttcccccctcggccaaaatgcagggggcaggagtgttgacaattaattggtgaactctcctaaaaaaatggaggcagagaaagactctggaagaagattgcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcggctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtcttctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccactcttgaactttgagggtttctgttctaggagtggactagaagtttaagcccagagtcagtaaacactgttttgaagtccaa

SEQ ID NO: 150147 - DNA, 4595 bp, Homo sapiens
  Payload ID: 9647
  Gene Symbol: KDM2B
  Gene Name: lysine (K)-specific demethylase 2B
  Uniprot ID: Q8NHM5
  ENST ID: ENST00000377071
  CDS Start-End: 74-4084
aaaagttaggcagtccttataggtatggaagccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtt

SEQ ID NO: 150148 - DNA, 1549 bp, Homo sapiens
  Payload ID: 9647
  Gene Symbol: KDM2B
  Gene Name: lysine (K)-specific demethylase 2B
  ENST ID: ENST00000446152
  CDS Start-End: 19-1549
gcgcgcgcttgtggggagatgaggcagctgctgcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtg

SEQ ID NO: 150149 - DNA, 544 bp, Homo sapiens
  Payload ID: 9647
  Gene Symbol: KDM2B
  Gene Name: lysine (K)-specific demethylase 2B
  ENST ID: ENST00000545022
  CDS Start-End: 81-544
gaagtcctttgcttacgtcttgtgatttagatcttgacttgtgttctgtctccctgcctctgtgttgcaggtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagag

SEQ ID NO: 150150 - DNA, 3170 bp, Homo sapiens
  Payload ID: 9647
  Gene Symbol: KDM2B
  Gene Name: lysine (K)-specific demethylase 2B
  ENST ID: ENST00000542973
  CDS Start-End: 390-2504
ctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataatctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagag

SEQ ID NO: 150151 - DNA, 2522 bp, Homo sapiens
  Payload ID: 9647
  Gene Symbol: KDM2B
  Gene Name: lysine (K)-specific demethylase 2B
  ENST ID: ENST00000543025
  CDS Start-End: 44-358
gccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaaggatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtc

SEQ ID NO: 150152 - DNA, 892 bp, Homo sapiens
  Payload ID: 9647
  Gene Symbol: KDM2B
  Gene Name: lysine (K)-specific demethylase 2B
  ENST ID: ENST00000539394
  CDS Start-End: 353-892
ctttgcaaacggatctgcctaagtgttggtgcaaaactttgtagatctcggctctggcttgctttatttatttattttttggtttgttttctttggtcttccctccttcccccctcggccaaaatgcagggggcaggagtgttgacaattaattggtgaactctcctaaaaaaatggaggcagagaaagactctggaagaagattgcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaaggatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaaga

SEQ ID NO: 150153 - DNA, 1188 bp, Homo sapiens
  Payload ID: 9647
  Gene Symbol: KDM2B
  Gene Name: lysine (K)-specific demethylase 2B
  ENST ID: ENST00000543852
  CDS Start-End: 318-689
cccaggcagcgccccaaagttggtgctgcaggtgcagcaaccctcctgccgccctcctccccggctggcccggccgtggcaggcgggaacccccaagggctcggttcgggggctcccgatgatctgccgccaacttggagggtgccttgctgcacagaagccacctgagctgggggcggccgggggcggccgaggcccaggcggaagccgggctagccggctggccgtggggagagcttagcggccgtggcaccgagccggggtgcccatgtgactgcggtgtgcttgggaagaggaagctgcagaggtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggagaaaaacaaattgtaggacacttccacccactctcacattttgactttttcaagtccttgagacctgggagttctagatacactcgagaaaccttttgttgtcatctcctgaggtcactcagcttgaagatgacttggacctccgaggaagggctgaggccaggtgccgctgagtgggccctgaggtcctctggtagacggatgacctgcaggctgggagcattgcatgccttgtgactgccttgccttttgttttggactgacgttggttaactcaatttggtgaggctccgagtctgtcaacaaataatgttgagcaaccgtatgtttaatgtccccaggcatgtggctgaaaccttttgaaggcgaagggtggaaggcgacaacctgtttgtaagtcaattctttgcaaatttttgtttcccgcagtcctctcttggaaaaaaaaataaataaataaataaaaatttgaattccttcatcagcatttgttttcacccagctggtttccattg

SEQ ID NO: 150154 - DNA, 528 bp, Homo sapiens
  Payload ID: 9647
  Gene Symbol: KDM2B
  Gene Name: lysine (K)-specific demethylase 2B
  ENST ID: ENST00000541511
  CDS Start-End: 236-528
atactgctgagcccccggtccacctgaaagcgaggtgcaaaaggcagccagagggagggggcaccaggagccctccgccttctaaccagctcagccccactccccgcattatctccactcgtgccggcgcgctgctggctcctccctgtccgtccccgccccattccttccctcttccccaaaccatggaaaggcaaagtgcagcggggaaaagaggtcagtggggtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacat

SEQ ID NO: 150155 - DNA, 600 bp, Homo sapiens
  Payload ID: 9647
  Gene Symbol: KDM2B
  Gene Name: lysine (K)-specific demethylase 2B
  ENST ID: ENST00000541318
  CDS Start-End: 476-600
attatctccactcgtgccggcgcgctgctggctcctccctgtccgtccccgccccattccttccctcttccccaaaccatggaaaggcaaagtgcagcggggaaaagaggtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggcatgtggctgaaaccttttgaaggcgaagggtggaaggcgacaacctgtttgtgcagcccaaattccgttaccccttctactatgagatgtgctggtatgtcctggagagatacgtgtactgtgtg

SEQ ID NO: 150156 - DNA, 460 bp, Homo sapiens
  Payload ID: 9647
  Gene Symbol: KDM2B
  Gene Name: lysine (K)-specific demethylase 2B
  ENST ID: ENST00000542030
  CDS Start-End: 84-460
atattgtcgatgactctggctggaagcaggaggcagatgccagcgttcccagcccaggcagcagcctgggagcaccggctctcatgcttcctgggctgtcgagaggccatcggaggaggggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggagga

SEQ ID NO: 150157 - DNA, 574 bp, Homo sapiens
  Payload ID: 9647
  Gene Symbol: KDM2B
  Gene Name: lysine (K)-specific demethylase 2B
  ENST ID: ENST00000538379
  CDS Start-End: 61-574
cttccctcttccccaaaccatggaaaggcaaagtgcagcggggaaaagaggtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttct

SEQ ID NO: 150158 - DNA, 2762 bp, Homo sapiens
  Payload ID: 9647
  Gene Symbol: KDM2B
  Gene Name: lysine (K)-specific demethylase 2B
  ENST ID: ENST00000536437
  CDS Start-End: 44-2164
gccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagcgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtc

SEQ ID NO: 150159 - DNA, 2301 bp, Homo sapiens
  Payload ID: 9647
  Gene Symbol: KDM2B
  Gene Name: lysine (K)-specific demethylase 2B
  ENST ID: ENST00000538046
  CDS Start-End: 105-1628
gtgtgtccacatctttgagtgccgggagtttaaaagttaggcagtccttataggtatggaagccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaaggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaaggtaagacgcagcctgcctgcagcgggcggccgcttcccacctccttcccacctcctgtagggtgaacagccgcgactttttgggtagctatggggcctcctgagatgaaggcaccgcagttaagatgaaggattttggtgatttgttccatgtttttgtttttaaaagggggttgctttacctagctgtgggaactgcgaacagtgccgcctggtggtcacttggaaaactggggggtgctgacacctcgcctttccctgtggttaggtggattttctgtctctccttccctcactcccttgcttcttcccttccttttcccttttcctttaattgcttcatgggctgtcttctcctcttttgaaaggaactttttctcagtgtgtaaaactggttgatgctcaacataaaaatgtctaatcggtcgagcgcggtggctcacgccataatctcagcattttgggaagtctaggcgggtggatcacctgaggtcaggagttcgagaccagcctggccaacatggcaaaaccccgtctctactaaaaatacaaaaaatgcgagcatggtggtgcacacatgtggtcccagctacttgggaggctgaggcaggagaatcacttgaacctgggaggtggaggttgcagtgatcagagactgcaccactgcactccagtctgggctacaaagtgagactctatctcaaaaaataaaataaaataaaataaaaaaaaaa

SEQ ID NO: 150160 - DNA, 3434 bp, Homo sapiens
  Payload ID: 9647
  Gene Symbol: KDM2B
  Gene Name: lysine (K)-specific demethylase 2B
  Uniprot ID: Q8NHM5
  ENST ID: ENST00000611216
  CDS Start-End: 456-2135
gtgtgtccacatctttgagtgccgggagtttaaaagttaggcagtccttataggtatggaagccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccactcttgaactttgagggtttctgttctaggagtggactagaagtttaagcccagagtcagtaaacactgttttgaagtcc

SEQ ID NO: 150161 - DNA, 4886 bp, Homo sapiens
  Payload ID: 9648
  Gene Symbol: KDM3A
  Gene Name: lysine (K)-specific demethylase 3A
  Uniprot ID: Q9Y4C1
  ENST ID: ENST00000312912
  CDS Start-End: 328-4293
taatgggggtcgcccgggagtcggaagggggaggggaaagggaggaggcagccaaggaattgtttttttctctggccccgccctcgcccggggggccaatggtgatgatctgtttcccccggagcctcgcccagctcctgtgtttcagccaatgagcggcggaagcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatat

SEQ ID NO: 150162 - DNA, 4621 bp, Homo sapiens
  Payload ID: 9648
  Gene Symbol: KDM3A
  Gene Name: lysine (K)-specific demethylase 3A
  Uniprot ID: Q9Y4C1
  ENST ID: ENST00000409064
  CDS Start-End: 59-4024
ctcggctgcggggagaggggagagaaagggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataata

SEQ ID NO: 150163 - DNA, 4928 bp, Homo sapiens
  Payload ID: 9648
  Gene Symbol: KDM3A
  Gene Name: lysine (K)-specific demethylase 3A
  Uniprot ID: Q9Y4C1
  ENST ID: ENST00000409556
  CDS Start-End: 366-4331
actatcgctcctccctctagctgagtacgcctgaaaccgcacgttctcttccctgccctcccccgctaaccctgcaccgccctcaccctttcctgtgagattcttccgccaagtggaaggctcatcttcggtcgacagcctacgcggttgaagaacaatccacctcgcccagctcctgtgtttcagccaatgagcggcggaagcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataata

SEQ ID NO: 150164 - DNA, 8741 bp, Homo sapiens
  Payload ID: 9648
  Gene Symbol: KDM3A
  Gene Name: lysine (K)-specific demethylase 3A
  ENST ID: ENST00000441719
  CDS Start-End: 97-2232
gctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgagaaccgatttgattctcctccagcccctctacacagttaaatcaagtgtttttgttgatttgtgtttggcgggtttcttgaagcatgtggagacagagtctgtaaagaacagttactacaaatcagttatttgcaggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacaggtatttactgcttatgttaaattcaacatctcttgtaattgtcatttgtctgtttttcaaataacccaaggatttctatcagtgcatttgaaaggaacctggggatagctatcaagtggaaagagagagagaaagaattcatacagttcatgtgacagttcagagacccgttctgacttttcacattactttcgtagactctactgtggcctcttgtagtaggttttacatttttgtttcttgaagaagcacaaagttctaaagtagtctacctaataagtagctgtcgaatttgtaaagggtttaaaaaaattttttgtgtattttgcagaattaaaattattaagataagctttaacatttttaaaattactaaatatattttgcctgtgtttatgcagagttgaaggaaatgatgaaatgaacctttagttgcccatcacacaatgtaaaaaatgttaattttctcagtcctcatatgtctctccttggtggcatccctctcctccccaccatcacatgtacgtcttgctgtcccttctccccctcgttccagtaatcagtatgccgcattgtgtttaataatcagaaatttacatttctataaagctgtggtgtcataaggcaggatgggagagcagaagacttgtaatatttggagtcagaactgaatttgagttcttttccttccacgtgctagttgtgttactttggctgaagtgagctggtttctatgtgcttcagcttcctcatcagtaatatagaaataagaagcaatattgatgattgggcatcacagaattacatcacatgtaaagagagggcctggaccacaacaggggtttgaatattttttttcctccttcttatgtatgtataaactcactcttgccagtttttaaaattattttcttctacagcagtcatcttagatttaatttatgggttcttttaagagctcatcacatttttaaagctaagtcaaaatagcattttctctttctctgcatcccatttccttctgaaatcaccgctttacctttcctgcctgcgtcatttattcgtttttaaccatgttttctgtgcctatcctgaattctgggatgagttcataggggagacaggcacaaactggtcattttaaaccagcatggtacatagagtaatagggatatgtaccagcaggggctggtgaaagggtgcggggggtaataccttgctgtgtttaagttgctgacatctctcctaccttttagttattctctactagtgcgggattactgcagctgtggggatacccagggctaactattaggtggttttgttctggatatttatcttacttgttggtcggctattaggagagaagaaaagaaaaggaagctgtcattcttcagcttatgtaaaatcgtcctttaatgcttaacacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcaggtaatgtaggcctcccatcctcctgccctattcagaacccccttctcagttcctttagcagacttctgacaaccccaccccaggctttccccctccttcacctcctgttttattctttattgtttcaggtgaatataatcaggtcaggatgtggccatgggtcttactttttaaagcagatggtcctaagctggacttttccagtcaggtttttgttgcttcctaccagtccctgttgggtttttgacgagggcatccaggcttggtgattcctatggtaaacttcagcagaggaagtgagggtgtgactacaggctgatgggatttgggagatcagacaaaatgtgctacaaaatcatgcacccctcttacctgaatgaaaagcctgtgctgaaggcagttctaggtgggctagggccgcgtggtgtcacatagtccccaggtgcctgcttcaaagggcagtgttgttggatcttaagtgccggttaatatctttaggagaatttctaggcctgcttctgtgctttcttgttttggttctgttttctggatctctggcttctctgtttggccagatagggtctttgctaaaggaacactctgctcttggacaagaatttgggagaattgccaaacagaaagatgtgagtgtttaaccaaaaataaatttccaaaatgtttttctccatccagtgtactaataggatttgctcatttaatcatatatagacaagaaacaaaatgatgggctgaatacagtttatcggcaggctttctttcttgcttgtcaatattttaatgttagactatttcacataaaggttagagcttctgggttgtcttagacggccaaaagatttggcaccctcacacagccagtagtagtgaggggtgtcacaggccatattcctgcttggcaataacaggctcaagtacggtggggtcagtcaccctgtttcactggtgactggtgtcactggacactccttccagcgcttgtcttcttcacagtccgtcttgctgtaagtaatgagatcttactaggagaggtgatcctttctcctagatgcttacccatgtagtttgagagcaagggtgtgtagcagatgaatggtgaaggttggaggtgctttgggagctcagagaactaagccgaaactgtcacatcaccatctgagacggagcaccagctccatggaaatataccaatagcagtgtgaagagggactgccttcgggagtggggacagagctggcagagttcagactaaagttttccttctcttcatttagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtgtgctgcttatggcatgtgtgaacagaggcataaggaatagcaatattatgttactacatgtggtgaactgactggcttggctaggggaattgtcacaacctgaaaagttaaatctgtacctgtcagattgaataggctgaaggtggttgctaaggaacaaggattctaaatgattagggttacacttctaaaaaaagcaggccttgtcttttatgtctgtgttttgtgttagagtgcatttagagatttttgttctctgctttcaagttagaagttagttcatctgatcatctcccagcatatatctgtttttattgccttgagaatctgagcacttcagacgttcatgtatccttggccctgagtgaccatgttctgagtgagttgctaagtttggttttgtccactgtcatgtagcaagtggtcctacttgttactagcaagggttgcagggatttggaagattctaggtttcccctgtagttggcaggtttttttttcagcaagggctatgtgtggaaattctaggcaactagaaagatgagtcgtgttcagttttaaaattgtttggcactgaggctgccggttgcaactcaggtgtctttggctgatattcttcagtcattcatgagtcttggatatgaacattcgtaacctgttagctggccccaagtatgtctttaacaagcatttgtttgaatcaaagtgtttctggctaaggatcatttggctcttccagaaaaccggcttggtcaccatattgttcttttgatattgtcactctgagtctctgctttaccagttactggatcaaggataaacaagtctaatctgcagctgtctttgggactgtttcgtaagtcagattaagtaaaggcaggtttctaataactttaaaacaagttcatttataaggatactgagcctacttatgtttaaaaatctagactaaaatattgtttaaatacagtatttacaaacttatgcagagcctgtcagtcatggtttatgggaactgacatcacattttcttcgtcattcttctgttggttcattcagctgaagtctttgatactactagtcgtcttctgccaatgggggcacttaagttgaagaaggcctgacatttatgaactgccaacactgtttagaggaaaaaaatggcttattgggccttagcatgttactgagttgcataatattttgaatgtattctaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagccagtgaatccagttttggcaaaccttaatctccctgcacattggaaatgaattacaggcagctgttcaaactcttcaggcaggattcctgtggactttgagattcatgttacctcatcttcttttttaaactgtacccaacttgtgagggtactctgtctaatgtatatttctagtgtttacagacagtaaatgtgtatatgtagtaactatttacagaacatgcatccttaaactgtgacttctcacctagtgcagaacttttaccaggctgtaaaagcaaaacctcgtatcagctctggaacaatacctgcagttattcttcagctgtttggacaacttagattgggtttataactattaggaatcactgcacagtttatttgggttgtgttttgtgtctgagtcccctccctcatcccttagggtccagaagagcaatggaggaagtgacagctaatgttgcagttcttattgtatggcataggactggcattatatagcagaaatcaactactgtacaatttcttggggttaaccatctttagttaaatggaattttaatttaaatgacgctttgctaattttaagtgttaagcattttgcattaaaatattcatataa

SEQ ID NO: 150165 - DNA, 709 bp, Homo sapiens
  Payload ID: 9648
  Gene Symbol: KDM3A
  Gene Name: lysine (K)-specific demethylase 3A
  ENST ID: ENST00000452034
  CDS Start-End: 347-709
attatccagtaactccacgcctttcttcatttatccttcaaaatggcggactttagacgttccacgatcagtaccacgtgcgcctgcgcctcccgcagccatttcgcccagcagcctaagctcggcgaggcgcctgcgcacgagcctccagagcactatcgctcctccctctagctgagtacgcctgaaaccgcacgttctcttccctgccctcccccgctaaccctgcaccgccctcaccctttcctgtgagattcttccgccaagtggaaggctcatcttcggtcgacagcctacgcggttgaagaacaatccaggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggac

SEQ ID NO: 150166 - DNA, 565 bp, Homo sapiens
  Payload ID: 9648
  Gene Symbol: KDM3A
  Gene Name: lysine (K)-specific demethylase 3A
  ENST ID: ENST00000427678
  CDS Start-End: 54-565
attttgtttttgtgtttttgcagggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttca

SEQ ID NO: 150167 - DNA, 4311 bp, Homo sapiens
  Payload ID: 9648
  Gene Symbol: KDM3A
  Gene Name: lysine (K)-specific demethylase 3A
  ENST ID: ENST00000542128
  CDS Start-End: 328-4311
taatgggggtcgcccgggagtcggaagggggaggggaaagggaggaggcagccaaggaattgtttttttctctggccccgccctcgcccggggggccaatggtgatgatctgtttcccccggagcctcgcccagctcctgtgtttcagccaatgagcggcggaagcggctccgaggggggcgggtccgggaggctgtgcgtgtcttgtgagagctcttgaaccaagtcagcgctggagtcggctaggcggctggaaacggcggctgccgccggtgactcagggaggcgggaggcgggggaggagctcttcctgcaggcgtggaaaccatggtgctcacgctcggagaaagttggccggtattggtggggaggaggtttctcagtctgtccgcagccgacggcagcgatggcagccacgacagctgggacgtggagcgcgtcgccgagtggccctggctctccgggaccattcgagctgtttcccacaccgacgttaccaagaaggatctgaaggtgtgtgtggaatttgatggggaatcttggaggaaaagaagatggatagaagtctacagccttctaaggagagcatttttagtagaacataatttggttttagctgaacgaaagtcacctgaaatttctgaacgaattgtacagtggcctgcaataacgtacaaacctctgttggacaaagctggtttgggatccataacttctgttcgctttctgggagatcaacaaagagtatttctttctaaagaccttttgaagcctatacaggatgtaaacagtcttcgactttctcttacggataatcagattgtcagtaaagaatttcaagctttgattgtgaagcatttagatgaaagccatcttttaaaaggtgacaaaaacttagttggttcagaagtaaaaatttatagcttggacccatctactcagtggttttcagcaaccgttataaatggaaacccagcatcaaaaactcttcaagtcaactgtgaggagattccagcactgaaaattgttgatccgtcactgattcatgttgaagttgtacacgataaccttgtgacatgtggtaattctgcaagaattggagctgtaaaacgcaagtcttctgagaataatggaaccctggtttccaaacaagcaaaatcttgctctgaggcctctcccagtatgtgtcctgtgcagtctgtacctacaacagtttttaaggagatactgcttggctgtactgcggcaactccacctagtaaggacccaagacagcaaagtactccccaggctgccaactctccacctaaccttggagcaaaaattcctcaaggatgtcataaacaaagtttaccagaggaaatttcttcctgtctaaatacaaagtctgaagctctgagaacaaaaccagatgtctgcaaagcagggttgctctcaaagtcctctcagattggaactggagacttgaaaattctgactgagccaaaaggcagctgtactcagcctaagacaaacactgatcaggaaaacagattggagtctgttccacaagcattgactggccttcctaaggagtgcttacctacaaaggcttcttctaaggcagaattggaaattgccaatcctcctgaactgcagaagcacctagaacatgcaccttccccatcggatgtttcaaatgcaccagaagtgaaagcaggtgtcaatagtgatagccctaataactgttcaggaaaaaaggtagaaccttcagctttagcttgccgatcacagaatttaaaggaatcttcagtaaaagtagataatgaaagctgttgttcaagaagcaacaataaaatccagaatgccccatccaggaagtcggttttgacagacccagctaaactcaaaaagctgcaacagagtggcgaggccttcgtacaggatgattcttgtgtgaacatcgtggcacagttgcctaaatgccgagagtgtcgcttggacagtctccgcaaggataaggagcaacagaaggactcacctgtgttttgccgcttctttcacttcaggaggttacaattcaacaaacatggtgtgttgcgggtagaaggcttcttaacaccaaacaagtatgacaatgaagcaattggcttgtggttacctttaaccaaaaacgttgtggggattgatttggacacagcaaagtacatcttggccaacattggagaccacttctgtcaaatggtgatttctgaaaaggaagctatgtcaactattgagccacacagacaggttgcttggaagcgagctgtcaaaggtgttcgagaaatgtgtgatgtgtgcgacaccaccatcttcaacctgcactgggtgtgtcctcggtgtgggtttggagtatgtgtggactgctaccggatgaagagaaagaattgccaacagggtgctgcttacaagactttctcttggctaaaatgtgtgaagagtcagatacatgaaccagagaacttaatgcccacacagatcattcctggaaaagcactctatgatgttggagacattgttcattctgtaagagcgaaatggggaataaaggcaaactgcccttgttcaaacaggcaattcaaactcttttcaaagccagcctcaaaggaagacctaaaacagacttctttagctggagaaaaaccgactcttggtgcagtgctccagcagaatccctcagtgttggagccagcagctgtgggtggggaagcagcctccaagccagccggcagcatgaagcctgcctgtccagccagcacatctcctctaaactggctggccgacctaaccagcgggaatgtcaacaaggaaaacaaggaaaaacaaccaacaatgccaattttaaagaatgaaatcaaatgccttccacccctcccacctttaagcaaatccagcacagtcctccatacgtttaacagcacaattttgacacccgtaagcaacaacaattctggtttcctccggaatctcttgaattcttctacaggaaagacagaaaatggactcaagaatacaccaaaaatccttgatgacatctttgcctctttggtgcaaaataagacgacttctgatttatctaagaggcctcaaggactaaccatcaagcccagcattctgggctttgacactcctcactattggctttgtgataatcgcttgctgtgcttgcaagaccccaacaataagagcaactggaatgtgtttagggagtgctggaaacaagggcagccagtgatggtgtctggagtgcatcataaattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcagctaatgtcatggtctatgtgggaattcccaaaggacagtgtgagcaagaagaagaagtccttaagaccatccaagatggagattctgacgaactcacaataaagcgatttattgaaggaaaagagaagccaggagcactgtggcacatatatgctgcaaaggacacggagaagataagggaatttcttaaaaaggtatcagaagagcaaggtcaagaaaacccagcagaccacgatcctattcatgatcaaagctggtatttagaccgatcattaagaaaacgtcttcatcaagagtatggagttcaaggctgggctattgtacagtttcttggggatgtggtgtttatcccggcaggagctccacatcaggttcataacttatatagctgcatcaaagtggctgaagattttgtttctccagagcatgttaaacactgcttctggcttactcaggaattccgatatctgtcacagactcataccaatcacgaagataaattacaggtgaagaatgttatctaccatgcagtgaaagatgcagttgctatgctgaaagtgaatccagttttggcaaaccttaatctccctgcacattggaaatga

SEQ ID NO: 150168 - DNA, 6813 bp, Homo sapiens
  Payload ID: 9649
  Gene Symbol: KDM3B
  Gene Name: lysine (K)-specific demethylase 3B
  Uniprot ID: Q7LBC6
  ENST ID: ENST00000314358
  CDS Start-End: 201-5486
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttatcgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcagcgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctg

SEQ ID NO: 150169 - DNA, 3034 bp, Homo sapiens
  Payload ID: 9649
  Gene Symbol: KDM3B
  Gene Name: lysine (K)-specific demethylase 3B
  ENST ID: ENST00000507996
  CDS Start-End: 1-63
gtgccagaaaaacagaaaggcagccggtcgcaggcctcgggagagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttct

SEQ ID NO: 150170 - DNA, 6324 bp, Homo sapiens
  Payload ID: 9649
  Gene Symbol: KDM3B
  Gene Name: lysine (K)-specific demethylase 3B
  ENST ID: ENST00000510866
  CDS Start-End: 1-825
atctttgtagaatttgatggctgtaactggaagcaacactcctgggtaaaagttcatgctgaggaagttatcgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcagcgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctgt

SEQ ID NO: 150171 - DNA, 3634 bp, Homo sapiens
  Payload ID: 9649
  Gene Symbol: KDM3B
  Gene Name: lysine (K)-specific demethylase 3B
  Uniprot ID: Q7LBC6
  ENST ID: ENST00000542866
  CDS Start-End: 118-2397
agatattcagccgaggtccctacagtgttcaaggtcacagggtcaaaatatatcagccagagggggaagaagggtggctctatggtgttgtgagccatcaggactccatcactcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgt

SEQ ID NO: 150172 - DNA, 4474 bp, Homo sapiens
  Payload ID: 9650
  Gene Symbol: KDM4A
  Gene Name: lysine (K)-specific demethylase 4A
  Uniprot ID: O75164
  ENST ID: ENST00000372396
  CDS Start-End: 135-3329
ggagtttcggccttcgcctgctggaaaagcagtaggatcggccagtggcgacagcaggagctgagcctaagccctggcggggctttgggctgtagattcctgtctgactaaagggacctcaaaaaggagggaaaatggcttctgagtctgaaactctgaatcccagtgctaggataatgaccttttatccaactatggaagagttccgaaacttcagtagatacattgcctacattgaatcccaaggagctcatcgggcagggctagccaaggttgttcctccaaaagagtggaagccacgagcatcctatgatgacattgatgatttggtcattcctgcccccattcaacagctggtgacggggcagtctggcctctttactcagtacaacatacagaagaaagccatgactgttcgagagttccgcaagatagccaatagcgataagtactgtaccccacgctatagtgagtttgaagagctcgagcggaaatactggaaaaatcttacattcaatcctccaatctatggtgcagatgtgaatggtaccctctatgaaaagcatgttgatgagtggaatattggccggctgagaacaatcctggacttggtggaaaaggagagtgggatcaccattgagggtgtgaacaccccatacctgtactttggcatgtggaagacatcctttgcttggcacactgaagacatggacctctacagcatcaactacctgcactttggagaaccaaagtcctggtactctgttccacctgagcatggaaagcggttggaacgcctcgccaaaggctttttcccaggaagtgctcaaagctgtgaggcatttctccgccacaagatgaccctgatttccccgttaatgctgaagaaatatggaattccctttgacaaggtgactcaagaggctggagagtttatgatcactttcccttatggttaccatgccggctttaaccatggttttaactgtgcggagtctaccaattttgctacccgtcggtggattgagtacggcaagcaagctgtgctgtgctcctgtagaaaggacatggtgaagatctccatggatgtgtttgtgagaaagttccagccagaaaggtacaaactttggaaagctgggaaggacaacacagttattgaccatactctgcccacgccagaagcagctgagtttcttaaggagagtgaactgcctccaagagctggcaacgaggaggagtgcccagaggaggacatggaaggggtggaggatggagaggaaggagacctgaagacaagcctggccaagcaccgaatagggacaaagaggcaccgagtttgtcttgaaataccacaggaggtgagtcagagtgagctcttccccaaggaggatctgagttctgagcagtatgagatgacggagtgcccggcagccctcgcccctgtgaggcccacccatagctctgtgcggcaagttgaggatggtcttaccttcccagattattctgactccactgaagtcaaatttgaagagcttaaaaatgtcaaactagaagaggaggatgaggaggaagaacaagcagcagctgccttggatctttctgtgaatcctgcgtctgtagggggacgccttgtcttctcaggctccaaaaagaaatcatcttctagcctgggctctggctcttcacgggattctatctcttctgattcagaaactagtgagcctctctcctgccgagcccaagggcaaacgggagttctcactgtgcacagttatgccaaaggggatggcagggtcactgtgggagagccatgcacgaggaagaaaggaagcgccgctagaagtttcagtgagcgggagctggcagaggttgcagatgaatacatgttttccctagaagagaataagaagtccaagggacgccgtcagcctttaagcaagctcccccgccatcacccacttgtgctgcaggagtgtgtcagtgatgatgagacatctgaacagctgacccctgaggaagaggctgaggagacagaggcctgggccaagcctctgagccaactgtggcagaaccgacctccaaactttgaggctgagaaggaattcaatgagaccatggcccaacaggcccctcactgcgctgtctgtatgatcttccagacttatcatcaggttgaatttggaggctttaatcagaactgtggaaatgcttcagatttagccccccagaagcagaggaccaagccattgattccagaaatgtgcttcacttcgactggctgcagcacggacatcaacctttctactccttatcttgaggaggatggcaccagcatactcgtttcctgcaagaagtgcagcgtccgggtccatgccagttgctatggggtcccccctgcaaaggcttctgaagactggatgtgttctcggtgttcagccaatgccctagaggaggactgctgtttatgctcattacgaggaggggccctgcagagagcaaatgatgacaggtgggtccacgtttcatgtgctgtggcaattctggaagcaaggtttgtcaacattgcagaaagaagtccggtggatgtgagcaaaatccccctgccccgcttcaaactgaaatgtatcttctgtaagaagcggaggaaaagaactgctggctgctgtgtgcagtgttctcacggccgctgcccaactgccttccatgtgagctgcgcccaggctgccggtgtgatgatgcagcctgacgactggccttttgtggtcttcattacctgctttcggcacaagattcctaatttggagcgtgccaagggggccttgcaaagcatcactgcaggccagaaagtcattagcaagcataagaacgggcgcttctaccagtgtgaagtggtcaggctcaccaccgagaccttctatgaagtcaactttgatgatggctccttcagcgacaatctttatcctgaggacatagtgagccaggactgtctccagtttggtcctcctgctgaaggggaagtggtccaagtgagatggacagacggccaagtctatggagccaagtttgtggcctcccaccctatccaaatgtaccaggtggagtttgaggatggctcacaacttgtggttaagagagatgatgtatacacactggatgaagagcttcccaagagagtcaaatctagactgtcagtagcctcagacatgcgcttcaatgagattttcacagagaaagaggttaagcaagaaaagaaacggcaacgagttatcaactcaagataccgggaagattatattgagcctgcactataccgggccatcatggagtaggtgcttccagggtccaagggattctcagccatccaggcaagagcactctgggttccacagcacagcagacatggaacgctgaagtctctgaaagtgaagttgtaaaaagaaaaggaatgaaataaccgacccatcatcttctcacccaccctcattgcattccgctgtagtgaaaggacgagccatttctgggcacgtggcagcagtcgctgatctcccagctgaggggctgagcactggaatgctgtggctgcactggccccagtccatagaggggtcaactatgctggctggactggctgccttgttcctggcctaggacttagcttcataactatcacctgcaccgactaggctgaggtgctggtacttgccccaacccctacttttgtatttatatgtgtgtgtgtgtgtgcgtgcgtgcgtgcgtgcgtgtatgtttggtctggaccagcttctgccagcccctggcctttactttcttccttgcctatgcagggcaaacaaaatgtgaaattctgccctcagctgagctgagtaagggctcctgggggttggctggagatgggtgtggcatctgtccaggcctggaaccgtctcaagacagtgctggcaaagctgcagtattgagatgctaaggagctgatgccacctctttgtcttcccctaaaggagaacatggggataacatgggtgtgtgcccacaacactctaggtgcagagcccctgtggcaaagtattacagggtgtgggtggggattaccctgaatcggggattttaatgatggaagcaggcagagcctggtgggtgattctgtcaacagaaaattgcaatcatgcaggggctgggagggttaggatgaaaaaactggggccattggaggcccactgtaggtgggagggagctgattttggggtggggggtgggactagagggcaatactgaaggggttaaacaggtttttgctcctcaagaatttgtttgcctgggcccaggattggagggcttcacaccaataccctgtgtatacaagaatcagatttataatacttccccttttttgttacgtatgaacactataaaccaaattattttgaaaactggtgcatcaccttgtccttagcaataaaatgtgttgagcaga

SEQ ID NO: 150173 - DNA, 5593 bp, Homo sapiens
  Payload ID: 9651
  Gene Symbol: KDM4B
  Gene Name: lysine (K)-specific demethylase 4B
  ENST ID: ENST00000159111
  CDS Start-End: 219-3509
gtcgccagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcgggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgatgaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcaggtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcg

SEQ ID NO: 150174 - DNA, 3058 bp, Homo sapiens
  Payload ID: 9651
  Gene Symbol: KDM4B
  Gene Name: lysine (K)-specific demethylase 4B
  Uniprot ID: O94953
  ENST ID: ENST00000381759
  CDS Start-End: 208-1554
ccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcgggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgatgaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcagaacccctccctgcgtatcgccgcacagaccctcccagccaggtatctggtgtccgcctggaggagaggccaaagcatctgcagcctcttggcttctgaccacaagaggccatggggacacggaggcaggtcccggcctaggaggagatccacttcatgcccagagtgaaggccaggcctcctgtgtctcgacgtctcgactccgcatggcaactcaagacccttgcagatgatagacagcgaagaaatgcgcgtggctgtgtccgtgaagctttgtttacagaccctgaaatccagatctcatgatttttacatgctaccaaatacgataatttttctgttttgagccacttaaaaatgtgaacattggccaggcacgatcgctcacacctgtaatctctgcactttggaggccaaggaaggaggattgcttgagtccaggggtttgagaccagcctgggcaacatattgagatgccatctctacaaaaaatttaaaaatcagctgggtgtggtggtgtgcgcctgtggtcccaactactgagaaggctgaggcaggaagatcacttaagcccaggaggtcaaggctgcagtgagccgagattgtaccactgcactccagcctgaatgacagagcaagaccttgtctctccaggaaaacaaacaaacaaacaaaaaaacatgtaaacactgttcctagcttgtgggtcgtacccagacaggctgctggcaggtctggtctttgagccaacagtggtggccttggtgtgggggcagcctcccccttccctttgagcagtgaccttccctctgcagccatccagtctctgctgccttgatcttgtcccagctggcgatggatggtgcccactcgagacccagccactgagcaccaaggttgggggcggctcagccttggccccccaccacgctctgcagaaacaggccttggaactggtttctgaaaagtcacttctggtccagaaccttctcctctaaatgggcgccttctttttcaacacgtccatctgtctgtgagtctgggactcctgggcggtctgggcatctgtctcggcctcctctgtcttccccacctcgcggcctctctcggagaatgttccctctgccccgagtgttttcacagcccctcctgacagccctgccaaggtgaatctgtctcttctgctcttgttctgtccttttgatttcctgcctcctgtgtgctcctcatgaagagctgcctcctggtgaggctactccaggcggcccccgcagcacagagctcgtgcaccccagctcccaggcccagccagacgtgctatttgcataatggttaattgattgtggctcaggctaattggtcaacagagtggattgccaataaaccggcaccacgttccaggagtggaatgggactagaggccgtctaaattgcctgccaggaggagatgcggaagccgctgcgctcaccgctgcttggaaccttctttgcacgcaggaagtggaccccccagaaccagcccttgcgtggcctggcctggcctccctgccccggccaccccctcacttctagtcacgacctgctcctcccaggagccccctcccgccctctcccgcgccgccatcctgggggctgccttcacccagcagcaagcctgaataacaaatgaagtcagcttcccaaggatataattttcttgaaagccttcagtatgtaaaacaaggctgattcactttt

SEQ ID NO: 150175 - DNA, 5027 bp, Homo sapiens
  Payload ID: 9651
  Gene Symbol: KDM4B
  Gene Name: lysine (K)-specific demethylase 4B
  ENST ID: ENST00000536461
  CDS Start-End: 41-3433
cctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcgggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgatgaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggcta

SEQ ID NO: 150176 - DNA, 3039 bp, Homo sapiens
  Payload ID: 9651
  Gene Symbol: KDM4B
  Gene Name: lysine (K)-specific demethylase 4B
  ENST ID: ENST00000588361
  CDS Start-End: 1-1871
ctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctggtgaggagcctggggcctggaggggcttggccgatcatggcctgggctgcagccctgcagggctgtctgctgcacaccctgtagcccacctgcgcacaaggcacttggggctgtccacgcctgctggaaaatgacactcagctggccctttaaatcagcttcctgcagagccttgggacctggcccagaaagaagatgaggaggccaggcctggtggctcatgcctgtaatcccagcactttgggaggccgaggcgggtcgatctcctgaggtcaggagttcgagaccagcctggccaacatatgaaaccccgtctctactgaaaatgcaaaacttagctctgcatggcgggacgtgcctgtgatcccagctactcgggagactaaggcgggagaattgcttgaacctgggcggcggaggttgcagtgagctgagattgcgccactgcactccagcctgggcgacagagtaagactctgtctcaaaaaaaaaaagatgaggagagcaaaatgcagatgttgctggggccgcgtccccactaagggctgtgcatgtggcagcgctgatggggaggacgcatttgtccctgtgcactccggcctctgcacacgtgtctcgtgggcccctggaggctgggcccgcagccagtagcacccagcagcgtcctgcctgcttttcctgcctggtttatcttcccagccgcggacacagtgcctggtgttgacattcaggcttgcgtggaggtggggctggaagcagacagatcagtctggcagggtgggtctgctggggagaccacaagggtgggactgatgccggccacaaagcccgggctcccatgcactggtgcgaggtgcccacgagcccggcgggcttggatgccatgcttggagcccacaggtgctgggccacctgggcagggctgtgcaggcagtcacagaggctcatctggaaggggagccctctttccttgttcgtggagtggagtgtgcagtgggtcacgccggcctggccgggcacggccaggcgattaggaagccggcagcccgcgggtgatgcttccgaggcaccagtgactcagtccacaaacgtgggcgtaaaaggcctcatgattcaggtggagtgatggtgcgatgcgtggtgcagtgataagtcctcctgcccgacgccttatggatcatctgacatttccagaacgcagcctcttcattaccggtgcttgtaacgatgaattaaaaatccttttacacga

SEQ ID NO: 150177 - DNA, 504 bp, Homo sapiens
  Payload ID: 9651
  Gene Symbol: KDM4B
  Gene Name: lysine (K)-specific demethylase 4B
  ENST ID: ENST00000588337
  CDS Start-End: 143-504
gggctcggtcgccagcaaccgagcggggcccggcccgagcggggcctgggggtgcgacgccgagggcgggggagagcgcgccgctgctcccggaccgggccgcgcacgccgcctcaggtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcgggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgatgaccttgaacgcaa

SEQ ID NO: 150178 - DNA, 5703 bp, Homo sapiens
  Payload ID: 9651
  Gene Symbol: KDM4B
  Gene Name: lysine (K)-specific demethylase 4B
  ENST ID: ENST00000611640
  CDS Start-End: 227-3619
agggctcggtcgccagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcgggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgatgaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcg

SEQ ID NO: 150179 - DNA, 4601 bp, Homo sapiens
  Payload ID: 9652
  Gene Symbol: KDM4C
  Gene Name: lysine (K)-specific demethylase 4C
  Uniprot ID: Q9H3R0
  ENST ID: ENST00000381306
  CDS Start-End: 566-3709
cggcgcccaggaggacgtgtggcgcgtggactacatcaggtccagccctgcgggaccccagccagcgcttccgggcaaggttctgtgcacctgttttctccttctacgcgagtatctttcccctccggaaagaatgggatatgcctgtgtccaaaggacaagaagatgcgcgccagcaagcctaagttaaccacagcgcggaagttgagcccaaagcaagagcgtgccgggcacctttaagctgtttgtaagcccacgtgactcaccaagtgcgggccccagcggtcacgtgacggcgcgcgcgccctcgcgcagggagagccggcggtgcgcgcgccttcgccgctgcctcccacccaccccctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattgaatgcaaacttcaaattcaaccaaaatcggggaaattaatgcatgtgctttacttttcttctaatgaagtcacatgatgcttctttgtgttgacatttattggtgcacaaaaatacttactgaatgtgtgctctgtgtaaaacaccaggagcaaacaaagataccatcaaggcatttgcaatcttgttagtagaagcaacattaaaagtattcaggagtagatcaaaggggactcggcataattgaatgtctgtctattcttttataggtttttcatggattgactaccttctgtctcagaaagttactgatgtttgtgtcagttcatcattaagctaaactctgactttcataataaaagggataaacaaagcctaaatgctagttgtgggaatactaaagcagttttttaaaaaggaaatagtagtttcatgccctcacataccattaaaagatgaacaaacatggacaaatattcaaaactgcagtcattgaaaaatataattcacaataatttagacttcatattattgtatcataaaatattcagtggaccctgaaatgaagtcagttttattcatttagaattatatctattgtgtctgtgaaatgataaatcctaaatagagaaatttgaatggatggggtttttctgactaaaatgaaattttttttctgaataattcagtttagtgagtgcttatgatatacttgtctgcagtgatagagtcactatagattatttggttattttggaaaaaccaagggttttcttaaatcagggatgtccaatctttttgcatccctgggccatacttgaagaagaagaattgtctttggcctcacataaactacactaacaatagctgatgagctactaaaaaaaaaaaaaa

SEQ ID NO: 150180 - DNA, 4655 bp, Homo sapiens
  Payload ID: 9652
  Gene Symbol: KDM4C
  Gene Name: lysine (K)-specific demethylase 4C
  Uniprot ID: Q9H3R0
  ENST ID: ENST00000381309
  CDS Start-End: 566-3736
cggcgcccaggaggacgtgtggcgcgtggactacatcaggtccagccctgcgggaccccagccagcgcttccgggcaaggttctgtgcacctgttttctccttctacgcgagtatctttcccctccggaaagaatgggatatgcctgtgtccaaaggacaagaagatgcgcgccagcaagcctaagttaaccacagcgcggaagttgagcccaaagcaagagcgtgccgggcacctttaagctgtttgtaagcccacgtgactcaccaagtgcgggccccagcggtcacgtgacggcgcgcgcgccctcgcgcagggagagccggcggtgcgcgcgccttcgccgctgcctcccacccaccccctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctcca

SEQ ID NO: 150181 - DNA, 1406 bp, Homo sapiens
  Payload ID: 9652
  Gene Symbol: KDM4C
  Gene Name: lysine (K)-specific demethylase 4C
  ENST ID: ENST00000401787
  CDS Start-End: 568-1023
gtcggcgcccaggaggacgtgtggcgcgtggactacatcaggtccagccctgcgggaccccagccagcgcttccgggcaaggttctgtgcacctgttttctccttctacgcgagtatctttcccctccggaaagaatgggatatgcctgtgtccaaaggacaagaagatgcgcgccagcaagcctaagttaaccacagcgcggaagttgagcccaaagcaagagcgtgccgggcacctttaagctgtttgtaagcccacgtgactcaccaagtgcgggccccagcggtcacgtgacggcgcgcgcgccctcgcgcagggagagccggcggtgcgcgcgccttcgccgctgcctcccacccaccccctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgaggtacattcatatttacagtgagttttgtaaagatcattggatgtgacagttttgttaccatttaagcagtttagaagtgttcttttgttgtgcttttgggtgatccataattcctcaaaggacaacaggaaatattcatcagtaggatttctgctgctggtatttttcaaactgaagctagataatcgtacaaatacctgaaattgttcagtagtaacatggtatgtggttatctggctgatcttttcattacattaaaactttttaaagcaaaaatacattataaaaatgtttggaaaacaggaaatatgatgcatcatactgacaccttaaagcagaagcagtattttagatatatttttccagtactttccctcaatcattaaaaaaatgttatatttgaa

SEQ ID NO: 150182 - DNA, 1064 bp, Homo sapiens
  Payload ID: 9652
  Gene Symbol: KDM4C
  Gene Name: lysine (K)-specific demethylase 4C
  ENST ID: ENST00000420847
  CDS Start-End: 1-1064
ccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaat

SEQ ID NO: 150183 - DNA, 4022 bp, Homo sapiens
  Payload ID: 9652
  Gene Symbol: KDM4C
  Gene Name: lysine (K)-specific demethylase 4C
  ENST ID: ENST00000438023
  CDS Start-End: 581-1702
gccataggtgcgcgtcggcgcccaggaggacgtgtggcgcgtggactacatcaggtccagccctgcgggaccccagccagcgcttccgggcaaggttctgtgcacctgttttctccttctacgcgagtatctttcccctccggaaagaatgggatatgcctgtgtccaaaggacaagaagatgcgcgccagcaagcctaagttaaccacagcgcggaagttgagcccaaagcaagagcgtgccgggcacctttaagctgtttgtaagcccacgtgactcaccaagtgcgggccccagcggtcacgtgacggcgcgcgcgccctcgcgcagggagagccggcggtgcgcgcgccttcgccgctgcctcccacccaccccctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagattataaaagtaatatttgtgcattggaggaaatttgtaaaataaggaaaagaataatgaaggaatcccatatcactcataacctcactatccagagataaccagtattaacattttgtatatatcctttacctatatatttattatatattttataatattatatatctttccaaaattggggccatgctctgttaataatctgacaatcagttttgagtgtttttttcatgtaactgattgatttgctgcaacatgatttttaatgcctgcatgtatttaatcccctgtagcttgtgtccacttttttgatattaactaagtaacaccataattttacatctttgcccagacttatgatgcttattttctgtcttttttttttccctgatatttattttctgcttatttagagtggtagtgagtggaagaaccttaggaacatggagtcaaacttcggcatcttataagaggtagacctgaggtgcagaactaactcaggtgttgatatttccccctgtagtttaccgcaatgatcgtcaaagtgtttgttagtaggtcaggaccaacattttaaaatgaggtggtaaaatagaataaaaagtattatagtgcttcctctgtggtaagggcaaatattcactcatgacatgtgtgagtatgtgtgtatgtgtgtatatagtgtcactatctgaaatatataactcactgtgggttacattcaagaaaagtttgagaaatactaatttggacagtcagtgtctttgataactgtgttaattcacagcactaaagaagccagcgctggaaggaggcagtatccaatcctgagttcagaatacacaccaggagaacatcttgagcattgttctgtcatggatggaaaacacaatattttcattaggtgtatgacttggtttccagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagtaaatggatctataattcatcaatcactggcttttcagcatttcacatcatctttatttctcacttttttggaacctgtcagatctgttgcatggactattggcattcttaatggttatatcattctttttcatatttctgctggtaaaagtatgagttggtatattcatccttttttcaccactttcatgtagtatccgtggagagcaggtctggttttttttgttggtttgtttgtttggggtccagttgaggagtcatgatggggttcctttcacatgtttggattttacttactttaagatctagtttataaaaacttaatttgaaagtct

SEQ ID NO: 150184 - DNA, 3039 bp, Homo sapiens
  Payload ID: 9652
  Gene Symbol: KDM4C
  Gene Name: lysine (K)-specific demethylase 4C
  ENST ID: ENST00000428870
  CDS Start-End: 190-2421
gctcatgctgctttcaatctcctggcatcaagcagtcctcccaccttggcctcccgaagttctggtacaagtgggagccaccatgcctgggcagaccctcagttctaaaaccgtcttggcttgtttaccatcagcccttcaccgtttcagaaagatgctgttcggagaacttgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttg

SEQ ID NO: 150185 - DNA, 3332 bp, Homo sapiens
  Payload ID: 9652
  Gene Symbol: KDM4C
  Gene Name: lysine (K)-specific demethylase 4C
  Uniprot ID: Q9H3R0
  ENST ID: ENST00000543771
  CDS Start-End: 79-2520
aggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgggaaggctgggaatctagacacagcaacagtaacaacaacaacaataacaatgaaggctcactgtgaaaacatcaattcattaggaaagttacatcccctccgccactgtttcagatgctgtttctcattctccatgggagcagccagcatcgtgtttaggatggggatacaatagcctgagctcctgattgagtcagaccctggactttcccttttgtatctgtcattttcctctggatcctcacacctttgtgtttaatttttttaaatttcatttgttgacttcctatgtggggtaaaatgacttcctttgattaatgtactttctgtatcctagagtttccctttccctttgtgatttagtccaacgtgtcctactacagcctcaaaaattgtcattggaatcaaaagctttccaaggtgcatcaggttaatgatttggatgcatcctgaggttgtctcctgtagcatggaggcattataataggagtctcagaagttacaccatttttctacagcacatcacaggcccagaggcttgaatctaagagaatccactctatgtctgtcagcctgaatccttccttcttgctgcacaacaaagcaactgaacgtattttgagtttaggtgaaaactatcactcattcatcaaagttctatctgggtgatatatgctatcgaaacagatgtggacactgggctgacagatgttgagaacggacctgttgctgaagctcatgttatcacacatgctgtgggaagagaggtcattggcattcaagatgcaacacctacaatatggtgaattaaagatgccatttgcatgga

SEQ ID NO: 150186 - DNA, 2978 bp, Homo sapiens
  Payload ID: 9653
  Gene Symbol: KDM4D
  Gene Name: lysine (K)-specific demethylase 4D
  Uniprot ID: Q6B0I6
  ENST ID: ENST00000335080
  CDS Start-End: 833-2404
aaggggcggggccgaagcggcccagggggcgggcgtttgaaatcagtgccttagagtagaccctaaacctcattttataccttcaagaaccaattacttaatgtctcttccgtcttttccgtccccgaccccctcccagactccttcattccggtactgcgtggacggaaagccccgggtagccgacaccacgtccccggctagcgggagagagcgtggaaaaggattacaccaaactgtttaaatccaacgactcctgcttccatcctttctcctgagctagaaccaacaaacctagagagttgggcttcggaaaaactagtgttttcatttaattggatatgaagaaagaacaaatatgtacggggcaaccacgatctttacaaagaacataagttccaggaaagcaggaaccttgtctctcttgttcactgggtgtatcctctgcatatagaacagtgcctggcacataataggtgctgaattttgttctaaacactgaggacattctctgctacatttgggtcgtacccccaggtctgagtaattcaatagacttaagaagacagagcccagcagcaaccgaaacataacagagttgcaggatcagctaacgtcaatgcctgggcaaagctgctgcccagagtggaatctcactagtgaataaacaagcccaagaaagattatcatctcatttgcaaaaaaaaaagtacgctggtagatcctgctacctcatagataacaccagtcaaatttttttttaaagtagcattttcctacattgtcaactatctagaacatacctaaaaactaagagtttactgcttattaaatggaaactatgaagtctaaggccaactgtgcccagaatccaaattgtaacataatgatatttcatccaaccaaagaagagtttaatgattttgataaatatattgcttacatggaatcccaaggtgcacacagagctggcttggctaagataattccacccaaagaatggaaagccagagagacctatgataatatcagtgaaatcttaatagccactcccctccagcaggtggcctctgggcgggcaggggtgtttactcaataccataaaaaaaagaaagccatgactgtgggggagtatcgccatttggcaaacagtaaaaaatatcagactccaccacaccagaatttcgaagatttggagcgaaaatactggaagaaccgcatctataattcaccgatttatggtgctgacatcagtggctccttgtttgatgaaaacactaaacaatggaatcttgggcacctgggaacaattcaggacctgctggaaaaggaatgtggggttgtcatagaaggcgtcaatacaccctacttgtactttggcatgtggaaaaccacgtttgcttggcatacagaggacatggacctttacagcatcaactacctgcaccttggggagcccaaaacttggtatgtggtgcccccagaacatggccagcgcctggaacgcctggccagggagctcttcccaggcagttcccggggttgtggggccttcctgcggcacaaggtggccctcatctcgcctacagttctcaaggaaaatgggattcccttcaatcgcataactcaggaggctggagagttcatggtgacctttccctatggctaccatgctggcttcaaccatggtttcaactgcgcagaggccatcaattttgccactccgcgatggattgattatggcaaaatggcctcccagtgtagctgtggggaggcaagggtgaccttttccatggatgccttcgtgcgcatcctgcaacctgaacgctatgacctgtggaaacgtgggcaagaccgggcagttgtggaccacatggagcccagggtaccagccagccaagagctgagcacccagaaggaagtccagttacccaggagagcagcgctgggcctgagacaactcccttcccactgggcccggcattccccttggcctatggctgcccgcagtgggacacggtgccacacccttgtgtgctcttcactcccacgccgatctgcagttagtggcactgctacgcagccccgggctgctgctgtccacagctctaagaagcccagctcaactccatcatccacccctggtccatctgcacagattatccacccgtcaaatggcagacgtggtcgtggtcgccctcctcagaaactgagagctcaggagctgaccctccagactccagccaagaggcccctcttggcgggcacaacatgcacagcttcgggcccagaacctgagcccctacctgaggatggggctttgatggacaagcctgtaccactgagcccagggctccagcatcctgtcaaggcttctgggtgcagctgggcccctgtgccctaagtccacgggctgtctttatatcccactgccctgctgtgtgacagtttgatgaaactggttacatttacatcccaaaactttggttgagtttgcaggactctaggcatgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccccctttttcttataaaactaggttctttatacagataaggtcagtagagttccagaataaaagatatgacttttctgagttatttatgtacttaaaatatgttgtcacagtatttgttcccaaatatattaaaggtaaccaaaatgttaaaatctg

SEQ ID NO: 150187 - DNA, 2737 bp, Homo sapiens
  Payload ID: 9653
  Gene Symbol: KDM4D
  Gene Name: lysine (K)-specific demethylase 4D
  Uniprot ID: Q6B0I6
  ENST ID: ENST00000536741
  CDS Start-End: 596-2167
ccttcattccggtactgcgtggacggaaagccccgggtagccgacaccacgtccccggctagcgggagagagcgtggaaaaggattacaccaaactgtttaaatccaacgactcctgcttccatcctttctcctgagctagaaccaacaaacctagagagttgggcttcggaaaaactagtgttttcatttaattggatatgaagaaagaacaaatatgtacggggcaaccacgatctttacaaagattttgttctaaacactgaggacattctctgctacatttgggtcgtacccccaggtctgagtaattcaatagacttaagaagacagagcccagcagcaaccgaaacataacagagttgcaggatcagctaacgtcaatgcctgggcaaagctgctgcccagagtggaatctcactagtgaataaacaagcccaagaaagattatcatctcatttgcaaaaaaaaaagtacgctggtagatcctgctacctcatagataacaccagtcaaatttttttttaaagtagcattttcctacattgtcaactatctagaacatacctaaaaactaagagtttactgcttattaaatggaaactatgaagtctaaggccaactgtgcccagaatccaaattgtaacataatgatatttcatccaaccaaagaagagtttaatgattttgataaatatattgcttacatggaatcccaaggtgcacacagagctggcttggctaagataattccacccaaagaatggaaagccagagagacctatgataatatcagtgaaatcttaatagccactcccctccagcaggtggcctctgggcgggcaggggtgtttactcaataccataaaaaaaagaaagccatgactgtgggggagtatcgccatttggcaaacagtaaaaaatatcagactccaccacaccagaatttcgaagatttggagcgaaaatactggaagaaccgcatctataattcaccgatttatggtgctgacatcagtggctccttgtttgatgaaaacactaaacaatggaatcttgggcacctgggaacaattcaggacctgctggaaaaggaatgtggggttgtcatagaaggcgtcaatacaccctacttgtactttggcatgtggaaaaccacgtttgcttggcatacagaggacatggacctttacagcatcaactacctgcaccttggggagcccaaaacttggtatgtggtgcccccagaacatggccagcgcctggaacgcctggccagggagctcttcccaggcagttcccggggttgtggggccttcctgcggcacaaggtggccctcatctcgcctacagttctcaaggaaaatgggattcccttcaatcgcataactcaggaggctggagagttcatggtgacctttccctatggctaccatgctggcttcaaccatggtttcaactgcgcagaggccatcaattttgccactccgcgatggattgattatggcaaaatggcctcccagtgtagctgtggggaggcaagggtgaccttttccatggatgccttcgtgcgcatcctgcaacctgaacgctatgacctgtggaaacgtgggcaagaccgggcagttgtggaccacatggagcccagggtaccagccagccaagagctgagcacccagaaggaagtccagttacccaggagagcagcgctgggcctgagacaactcccttcccactgggcccggcattccccttggcctatggctgcccgcagtgggacacggtgccacacccttgtgtgctcttcactcccacgccgatctgcagttagtggcactgctacgcagccccgggctgctgctgtccacagctctaagaagcccagctcaactccatcatccacccctggtccatctgcacagattatccacccgtcaaatggcagacgtggtcgtggtcgccctcctcagaaactgagagctcaggagctgaccctccagactccagccaagaggcccctcttggcgggcacaacatgcacagcttcgggcccagaacctgagcccctacctgaggatggggctttgatggacaagcctgtaccactgagcccagggctccagcatcctgtcaaggcttctgggtgcagctgggcccctgtgccctaagtccacgggctgtctttatatcccactgccctgctgtgtgacagtttgatgaaactggttacatttacatcccaaaactttggttgagtttgcaggactctaggcatgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccccctttttcttataaaactaggttctttatacagataaggtcagtagagttccagaataaaagatatgacttttctgagttatttatgtacttaaaatatgttgtcacagtatttgttcccaaatatattaaaggtaaccaaaatgttaaaa

SEQ ID NO: 150188 - DNA, 2191 bp, Homo sapiens
  Payload ID: 9653
  Gene Symbol: KDM4D
  Gene Name: lysine (K)-specific demethylase 4D
  Uniprot ID: Q6B0I6
  ENST ID: ENST00000610872
  CDS Start-End: 201-1772
gctgctgcccagagtggaatctcactagtgaataaacaagcccaagaaagattatcatctcatttgcaaaaaaaaaagtacgctggtagatcctgctacctcatagataacaccagtcaaatttttttttaaagtagcattttcctacattgtcaactatctagaacatacctaaaaactaagagtttactgcttattaaatggaaactatgaagtctaaggccaactgtgcccagaatccaaattgtaacataatgatatttcatccaaccaaagaagagtttaatgattttgataaatatattgcttacatggaatcccaaggtgcacacagagctggcttggctaagataattccacccaaagaatggaaagccagagagacctatgataatatcagtgaaatcttaatagccactcccctccagcaggtggcctctgggcgggcaggggtgtttactcaataccataaaaaaaagaaagccatgactgtgggggagtatcgccatttggcaaacagtaaaaaatatcagactccaccacaccagaatttcgaagatttggagcgaaaatactggaagaaccgcatctataattcaccgatttatggtgctgacatcagtggctccttgtttgatgaaaacactaaacaatggaatcttgggcacctgggaacaattcaggacctgctggaaaaggaatgtggggttgtcatagaaggcgtcaatacaccctacttgtactttggcatgtggaaaaccacgtttgcttggcatacagaggacatggacctttacagcatcaactacctgcaccttggggagcccaaaacttggtatgtggtgcccccagaacatggccagcgcctggaacgcctggccagggagctcttcccaggcagttcccggggttgtggggccttcctgcggcacaaggtggccctcatctcgcctacagttctcaaggaaaatgggattcccttcaatcgcataactcaggaggctggagagttcatggtgacctttccctatggctaccatgctggcttcaaccatggtttcaactgcgcagaggccatcaattttgccactccgcgatggattgattatggcaaaatggcctcccagtgtagctgtggggaggcaagggtgaccttttccatggatgccttcgtgcgcatcctgcaacctgaacgctatgacctgtggaaacgtgggcaagaccgggcagttgtggaccacatggagcccagggtaccagccagccaagagctgagcacccagaaggaagtccagttacccaggagagcagcgctgggcctgagacaactcccttcccactgggcccggcattccccttggcctatggctgcccgcagtgggacacggtgccacacccttgtgtgctcttcactcccacgccgatctgcagttagtggcactgctacgcagccccgggctgctgctgtccacagctctaagaagcccagctcaactccatcatccacccctggtccatctgcacagattatccacccgtcaaatggcagacgtggtcgtggtcgccctcctcagaaactgagagctcaggagctgaccctccagactccagccaagaggcccctcttggcgggcacaacatgcacagcttcgggcccagaacctgagcccctacctgaggatggggctttgatggacaagcctgtaccactgagcccagggctccagcatcctgtcaaggcttctgggtgcagctgggcccctgtgccctaagtccacgggctgtctttatatcccactgccctgctgtgtgacagtttgatgaaactggttacatttacatcccaaaactttggttgagtttgcaggactctaggcatgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccc

SEQ ID NO: 150189 - DNA, 2339 bp, Homo sapiens
  Payload ID: 9654
  Gene Symbol: KDM4E
  Gene Name: lysine (K)-specific demethylase 4E
  Uniprot ID: B2RXH2
  ENST ID: ENST00000450979
  CDS Start-End: 301-1821
ccaagcctgagaatcaggagaagcctcacagtgacacccccaactgaggaaactcacagagctgggacatactctacttcttcagaaaaaagtatactgactagagtggagtccccctggggagtcagaaagcctgtgaaagatctcacttgttcaaaagtccaagtgtgaattactgtctcacagataaaccaaagtattttgaaaaacaaaggggagaaaagaaattactccccagaactctcaggcatctagaggacacccaagaacgtgggagtcagctgcttcttgtgtgcagccatgaagtctgtgcactccagtccccagaacacgagtcataccatcatgacgttttacccaaccatggaagaatttgcagatttcaacacatatgttgcttacatggagtcccaaggcgcacatcaagctggccttgccaaggtaattccacccaaggaatggaaagccagacagatgtatgatgatatcgaagacatcttaatagccactcccctccagcaggtgacctctgggcagggaggtgtgtttactcaataccataaaaagaagaaagccatgagggtggggcagtatcgccgcttggcaaacagtaaaaaatatcagactccgccacaccagaattttgcagatttggagcaacgatactggaagagccaccccggtaatccaccaatttatggtgctgatatcagcggctccttatttgaagaaagcactaaacaatggaacctaggacacctgggaacaattctggacctgttggagcaggaatgtggggttgtcatcgagggtgtcaacacaccctacctgtactttggcatgtggaagaccacgtttgcctggcacacagaggacatggacctttacagcatcaactacctgcactttggggagcccaaaacttggtacgtggtgcccccagaacatggtcagcacctggaacgcctggccagggagctcttcccagacatttctcggggctgtgaggccttcctgcggcacaaagtggccctcatctcgcctacagttctcaaggaaaatgggattcccttcaattgcatgactcaggaggctggggagttcatggtgacctttccctatggctaccatgctggcttcaatcacggcttcaactgcgcagaagccattaattttgccactccacgatggattgattatggcaaaatggcctctcagtgtagctgtggggagtcgacagtgaccttttccatggacccctttgtgcgcattgtgcaacccgagagttatgagctctggaaacacaggcaagacttggccattgtggaacacacagagcccagggttgcagaaagccaagagctgagcaactggagagatgatatagtacttagaagagctgctctgggcctgaggcttctcccaaacctcacagcccagtgtcccacacagcctgtgtcctcagggcactgttacaacccaaaaggctgtggcactgatgctgtgcctggatccgcattccaaagctctgcatatcatacccagacccagtcacttaccctggggatgtcagccagggttcttctcccttccactggaagctggggttctggtcgtggtcgtggtcgtggtcaaggtcaaggtcgaggttgcagtcgtggtcgtggtcatggttgttgtactcgagaactggggactgaggagccaactgttcagcctgcatccaagaggcgccttttaatgggtacaaggagtagagctcaaggccacaggcctcagctcccgcttgccaatgatttgatgacaaatctgtccctttgagtggtggccttcagcatcttgccaaggcttctggctgctgctgtgtccctgatcttcaactcctggggcccccactggatcgtgatgaaaccatgcaccctggcctgtgcctgctatccctcaacagcactactagtaatctccctgatgttgtctgcatgactcctcccaatgtcattgtgcctttgattaagttttccagggacactggtggggactggaactgattaagttcaccagggacacttgcctggtgaacatgggcaaggctgtagcaatggaccacttttacggctctagggttctgactccaactaagttttccagaatctcctgggctcctgactcatctgctgggtctaaagacactgagtttagggatattttcctccaatacatgatcaatcctctggatccacggctatggaatatggtgacaaatgtcagtgtctctcttattccaaccccaggatcagagaagattctttacctgcagtaactgacacatttccaaggcc

SEQ ID NO: 150190 - DNA, 6444 bp, Homo sapiens
  Payload ID: 9655
  Gene Symbol: KDM5A
  Gene Name: lysine (K)-specific demethylase 5A
  ENST ID: ENST00000382815
  CDS Start-End: 156-5324
gaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaagtattttttgggaaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaagggagttgtatttgtaacgaagaagagaagaataaaaaatattagttttaaaagtggcctatgtgactgcttttctaaaaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccattttt

SEQ ID NO: 150191 - DNA, 10763 bp, Homo sapiens
  Payload ID: 9655
  Gene Symbol: KDM5A
  Gene Name: lysine (K)-specific demethylase 5A
  Uniprot ID: P29375
  ENST ID: ENST00000399788
  CDS Start-End: 364-5436
gcagaactttggcgggcaaggagacaaacagccacactgtgctgccggggaagagaagaagaaggaaaggccagacacacaggcgtcgtgcagctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatgaatagcttcctgtcaccttctgacgttttgaaacttaaatatgtcttttcgttgatactgtgggattttctgtatttacttgacagtcatggaggatttggtatgacttgaccacaggtttagaccaaggctgagaagaacagaagggagaaattaatggcaaaacaaaaaatacacaaatctgcggttttggaattaatgaaacaagattcatctatttaaagaaatgttggtgttctaatacaaagcattattttcacttagagaaaattacttacttgctcccttctgtattgtaatattttgtattaagacatgatttaaaatgtctttctacccttatctcctctaaactgcaactgaagttgcaattcttcatcattagtattttaactctggcaaaggttatagaaagaaaaatggaaatatggtaggcctgtggtattcttaaaagctaagtcattagaactatgcagatccccaagtttaaaagtacaaatacagcaccagtagttagctttctagctgggggagaagacaggagatttttcttccacagatgtttattttgcttcctgataggtactgcagcaaagccatgttgatgtgtagatgcatgacttcctcactaagctgctgcacaccagctttgcctgcatgattcaaatttgtgcctcagtaaaattataaattattgcatgtcataccttgaataatggaaacggcaaacattaaacctgtgattacccataatgtactttaataataaaaaacatggcagccaggtgcagtagagtgcacctgtggtcaggaggctgaagtgggaagattgcttcaacctgtgagtttgagtcccgcctggtcaacagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccatacccaccctaacccctgtcatttacattggtggcaactttaaatggtaaccaagcaaaagtacattttgataatgagtattgataatcctgaggaaaactagtgagtatatgggagccacctttgacctgtgccaaagcagtttctaatttcatttgctaactataaaataaagaactgagccaaaataatttgatcagtggtgtgattagcctattatcattgctgagaatagtgtttttggagtgtgaagtgattcctgaagatttcacctgccttctgtttccagcaagaatccagtgatgaccaacacatttcctcacttttggttcttgagaagtttatccctttgcaacaaaccattaatagggaaaacaaggaaatgctttccctttctctttggcttcttaaagctcacaaccaattcagaccccaagttacttcagagaagcaaatggcaccttttccccattgccaaggatcccagcttatgcagatatgaaggacggatcatttctgaaaatgttaagactctgcttgcagtggacttggcctcagtttcatgaaatgtgtaactctgtatgtgtatgttaggaggagggttggttgaaagagcgggggcagggaggggaatctgattacctcttgggaaataattttcttgccaacaaaaagatacacttgaagtttcttaaggtggcaagtccattaaaaaaaaaaattgtgttggaccctcccagtttagatcaagtatttcttgggggtcttgctattgtggttgataccaataaatggaagatccagaatattttcatttaaagctcaaccattaattggaacatggtgaaacattgtacacattgtaaaagtagggaacagtacaaaagaatggaatcaaatactatattatgtgaataaactagagtgattttggaatttcactctcttca

SEQ ID NO: 150192 - DNA, 558 bp, Homo sapiens
  Payload ID: 9655
  Gene Symbol: KDM5A
  Gene Name: lysine (K)-specific demethylase 5A
  ENST ID: ENST00000536014
  CDS Start-End: 191-558
ctcatctcagggctagggtttctgaaaaggttatctgagctctagtctcaccggatggtattactagacaagaactccagactaattattgccgcagtgaaaaagtcttagcggggaaagagaaggagcagcaataattctaaaatttagaggtttaggaaaaattggtttatagtggaggtggaaggaaatgttgaaatctcttgacgtagggaactcaagatcaacgattttagaatcacagttattgcagataactaggtttgcctataaggttaattataatctcacctttgaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagt

SEQ ID NO: 150193 - DNA, 2338 bp, Homo sapiens
  Payload ID: 9655
  Gene Symbol: KDM5A
  Gene Name: lysine (K)-specific demethylase 5A
  ENST ID: ENST00000544760
  CDS Start-End: 192-2338
tggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaat

SEQ ID NO: 150194 - DNA, 551 bp, Homo sapiens
  Payload ID: 9655
  Gene Symbol: KDM5A
  Gene Name: lysine (K)-specific demethylase 5A
  ENST ID: ENST00000535014
  CDS Start-End: 174-551
aacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgagattgttgccagcaaaggaggttttgaaatggtcaccaaagagaagaaatggtctaaagtgggtagtcgcttgggatatctgccaggaaaaggaactgggtctcttttgaagtcacattatgaaagaattctctac

SEQ ID NO: 150195 - DNA, 575 bp, Homo sapiens
  Payload ID: 9655
  Gene Symbol: KDM5A
  Gene Name: lysine (K)-specific demethylase 5A
  ENST ID: ENST00000543507
  CDS Start-End: 183-575
cttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaagttttggcagatttcttcagtttccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaag

SEQ ID NO: 150196 - DNA, 4418 bp, Homo sapiens
  Payload ID: 9656
  Gene Symbol: KDM5B
  Gene Name: lysine (K)-specific demethylase 5B
  ENST ID: ENST00000235790
  CDS Start-End: 594-4418
acactcccggcttcttctggctcagccgctcggctccccggggaggcctgggctgtgctggtggggatggggtccgggcgaggccgtgtttgtaggggaacgtcagacggagagacctccgaagatttcgtgctcgtttcccccggccctcaggctccgggcactgaaaggcagtcacccaccgcagcccttccagccctgtctacagcgcctcgggcctgggggcagtgagtgaggggtgggtgttgctgaaaccatccgtaacggctccaacgttcgctgaggagagcccggccaactccttcctccgtggccggaactgggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacggaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggaccccc

SEQ ID NO: 150197 - DNA, 6449 bp, Homo sapiens
  Payload ID: 9656
  Gene Symbol: KDM5B
  Gene Name: lysine (K)-specific demethylase 5B
  Uniprot ID: Q9UGL1
  ENST ID: ENST00000367264
  CDS Start-End: 114-4856
caactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagagagacagagtctcgctgtgttgcccaggctggagtgcagtggcgcgatcttggctcactgcaacctccgcctcctagattccagcaattcttctgcctcagcctcccaagccatgaatattaaaatagaacccgaggagacaacggaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctcccc

SEQ ID NO: 150198 - DNA, 10345 bp, Homo sapiens
  Payload ID: 9656
  Gene Symbol: KDM5B
  Gene Name: lysine (K)-specific demethylase 5B
  Uniprot ID: Q9UGL1
  ENST ID: ENST00000367265
  CDS Start-End: 1166-5800
ttcagtctgttgaaggataccccgttgtgtatttctacctgtatgtaccagagacacctcaaattcaaaatgtccagaaatgaacacagtatcttcttcccttgagtaactcgccttctgtatataattggggtgaatgttccagcaatgccaacgggctagcatctactcaggcaggtacgccagacatctgaatcttaatacctcgtcgtcccccctcaatctgtcactatgtcctaattttatttcctacctttgcatcccttcctcataattatcagcaccactgccttaatttagatcctatcattccttgtctggattatttcaagtctttcgcccctctcaagtctgacctcgtcatagactgtttgtggatgattattttccctgcaacatctccacctcccaatagtctccatcacttattagccatgtgaattatggcaaattgcttaacctacctatgcctcactttccttattgtaaagtggaaataagagtacctatctcatagggttgtgtgattaatcatgcgatgcaattagaacagtgcctaggatatgaaagtgccccaaaatgttacgttattattattattactactattgccttctcatgaacatgctatgtgtatgttcaagctgttatctctactggaaaatccttctccgtttccaatactctttccaaaaccccctcctgggttttactgcacctaccattgtgtactgacgtgattgaatgattggcttatgggactgatcctttctaccagacttaacttcttcagggcaggaactctgatacatagtaaatggtcaataaaagttggctcaactgaaaccctaaggataaactccatccacagcggaaggcgcggccccgcccgattcgggggcggggcggggagccgcgcgcggagggtgggtcgatgggggtggggtgggactctttttcctcgccgtggcggcggaggcgcacggcgtgggcttgcggcgagacgtcgtcgtcggaggctgaaaaagcccaaggtgctgccgttgcccgtacaactcggacttgctgttgctcgagccgcgtctgcacgggtctcggaccgagcggagctcgcagcctcggtcccggagcccaccttcgcctcgcccttgcccagcctgcggtgatggaggcggccaccacactgcacccaggcccgcgcccggcgctgcccctcgggggcccgggcccgctgggcgagttcctgcctccacccgagtgcccggtcttcgaacccagctgggaagagttcgcggaccccttcgctttcatccacaagatccggcccatagccgagcagactggcatctgtaaggtgcggccgccgccggattggcagccaccatttgcatgtgatgttgataaacttcattttacgccacgtatccagagactgaatgaattggaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagacactaaggacaaggagtacaaaccccatgatattccccagaggcagtctgtgcagccttcggaaacgtgccccccagcccgacgagcaaaacgcatgagagcagaggccatgaatattaaaatagaacccgaggagacaacggaagccagaactcataatctgagacgtcgaatgggttgtccaactccaaaatgtgaaaatgagaaagaaatgaagagtagcatcaagcaagaacctattgagaggaaagattatattgtagaaaatgagaaggaaaagcccaagagtcgatctaaaaaagccaccaatgctgtggacctgtatgtctgtcttttatgtggcagtggcaatgatgaagaccggctactgttgtgtgatggctgtgatgacagttaccataccttttgcttgatcccacctctccatgatgttcccaagggagactggaggtgtcctaagtgtttggctcaggaatgtagtaagccacaagaagcatttggctttgaacaagcagccagggactataccctccgtacttttggggaaatggcagatgcgttcaaatctgattacttcaacatgccagtccatatggtccccacagagcttgttgagaaagaattttggagactagtaagcactattgaggaggatgtcacagtggaatatggagctgacattgcctcaaaggaatttggcagtggctttcctgtccgagatgggaaaatcaaactctcacctgaggaagaggagtatcttgatagtggctggaatttgaacaacatgccagtgatggagcagtctgtccttgcacatattactgctgatatatgtggcatgaaacttccttggttgtatgtgggaatgtgcttttcttcattctgttggcacattgaagaccactggagctattcaattaactacttgcactggggtgagccaaaaacctggtatggagtcccagggtatgctgctgagcagctagaaaatgtaatgaagaaactagctccagaactctttgtgtcccagccggatctcctccatcagcttgtgaccatcatgaaccccaataccctgatgactcatgaagtgcctgtttaccgaactaatcagtgtgctggggagtttgtgattacatttccaagagcctaccacagtggttttaaccagggttttaattttgctgaggctgttaacttctgcactgttgattggctgccattaggccgacagtgtgtggagcattatcgcttgcttcatcgatattgtgtgttttcccacgatgagatgatctgcaagatggcttccaaggctgatgtattagatgttgtagtggcttcaactgttcagaaagacatggccattatgattgaggatgagaaagctttaagagaaactgtccgtaaattgggagtgattgattcggaaagaatggattttgagctgttgccagatgatgaacgtcagtgtgtaaaatgcaaaactacatgcttcatgtctgccatctcctgttcttgtaaacctggccttcttgtttgcctgcatcatgtaaaagaattgtgttcctgtcctccttacaaatataaattgcggtataggtacacgctggatgatctctaccctatgatgaatgcattgaagcttcgagcagaatcttacaacgaatgggccttgaatgtgaatgaagctttggaggcaaagatcaacaagaagaaaagccttgtcagcttcaaggctttaattgaagaatctgaaatgaagaaattcccagacaatgatcttttgcgacaccttcgcctagtcacacaggatgcagagaagtgtgcctctgttgcgcagcagttgcttaatggcaaaaggcaaactagatatcgatctggtggagggaaatcccaaaatcagttgacagtgaatgagctccggcagtttgtaacacagctgtatgctcttccatgtgtcctcagtcagacaccattactaaaggatctcttgaatcgtgtagaagattttcaacagcatagtcagaaactactctctgaggaaacgcctagtgctgcggagctgcaggacttgctagatgtcagctttgaatttgatgttgaacttccacagcttgctgagatgcgtatccgtttggaacaagcccgttggctagaagaggtgcagcaagcttgcctagaccccagctcccttactttagatgatatgagacgtctcatagacctaggggtagggctggccccgtattcagcagtggagaaagctatggcccggctgcaggaactgctcacagtgtcagagcactgggacgacaaagccaagagtctcctcaaggccaggccacgacattcattgaatagccttgctacggcagtaaaggaaatcgaagagatccctgcatatctgcccaatggtgcggctctgaaagactcagtgcagagagccagagactggcttcaggatgtagagggcctgcaggctggaggacgtgtgccagtgttagacacactcatagaacttgttacacgaggccgatctatccccgtacatctgaattctttgccaagactggaaaccctagtagctgaggttcaggcttggaaagaatgtgctgttaatacattcttgactgagaattctccatattctctcttagaggtgctgtgtcctcgatgtgatattggccttttgggattgaaaaggaagcagagaaagttaaaggagcccttgccaaatggaaagaaaaaaagcaccaaattagagagtctgagtgacctggagagagctttaactgaaagcaaggagactgcttcagctatggcaactcttggggaagctcgcctaagggaaatggaagccttgcagtctctcagactcgccaatgaagggaaattgctgtcgcctctccaagatgtggatataaaaatctgcctatgtcagaaggccccagctgcccctatgattcaatgtgaactctgcagggatgctttccacaccagttgtgtggcggtacccagtatttcacagggcctgcgaatctggctttgtccccattgtcggaggtcagagaaacctccattagagaaaattctgcccctgctcgcctcccttcagcgtatccgagttcgccttcctgagggagatgcacttcgatatatgattgaaagaaccgtgaactggcagcacagagcccagcaactgctttcgtcagggaatcttaaatttgtgcaagatcgagtgggctcaggactgttatatagcagatggcaagcctcagcaggacaggtgtcagacacaaacaaggtatctcaacctcctggcacaacatcattttctttgcctgatgactgggacaacagaacctcatatttgcactcccccttctcaactggacgaagttgtatccccctccatggtgttagtccagaagtgaatgaactattgatggaagcccagctgctccaggtatcccttcctgaaattcaggaactttaccagactttacttgcaaagccaagccctgctcagcagactgaccgaagctcaccagtgagacccagcagtgagaagaatgactgttgccgagggaagcgagatggaattaacagtcttgagagaaaactgaagagacgcctggaaagagagggcctctccagtgagcggtgggaacgagttaagaaaatgcggacccccaaaaagaagaaaatcaaactgagccaccccaaggacatgaacaatttcaagttagagagagagcgtagctatgaattagttcgttctgctgaaactcattccctgccctcagacacatcctattccgaacaggaagactctgaggatgaagatgccatctgcccagctgtgagctgcctgcagccagaaggagatgaggtggactgggtccagtgtgatggcagctgcaatcagtggtttcatcaggtctgtgttggtgtctccccagagatggcagagaaagaagactacatctgtgtgcgctgtactgtgaaggacgcaccaagccgaaagtaaaaacacaaaaacagatacccccctacttaatgtaattcaggactccaaccaagaggatttcttcaaatctcagcaaagctacaggactggtactcaagccagcctgtaaacggtgctatttctattccttatgggatcatttttccaggactctttgaagaaaagaaaaaacaactaaaaaaatttttgacactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctgtaagtaattgccacagctgtattttggctttctccctgtcccttcctttctcccctattttttggtagcttgtatcaaatgttacagtttatattgtggaataaatccttcgtcctaacataacactaaatgctgattatttagagccattagagcacagcttcttctgcccctctactgttgcacagccagaaggggctgcttgcttttgcctctgcccaaccaggttgcagtagcagtggatgttagcctgcaaacaacattaggggattcttcttttgtgtcctgctctgtttggtgggccatatgcctacagccctcactaacaaagaacccctctgtcttcaaggactagaacctatctttaaagccgtgctcttttaaaataagctttctcagaatgttggcaaatcacttcaatcctcaaatcagtcttccttgtggaatgctgcctttattatatttgaattgacaggggaacttggtttagggttaagacgttggaaggaaatctaaggaaaattaatcctcacagaggtccgggtttagtatatgtcttgagaggagacttgtgaattcccagactctgcctcctggtttcctttctcatttctttctaactgtagctatcattactggctgtggatagcccatagctattttccttgcttttcttttttaaaggggtctgttctgcagtggagaagacattctggtgaccagacttttgcttaccttttcctattctgttgccaatttttgttttccccacattctatagccataaacctgaagatgagtaaaactggtgggtctttaataaaacaacaacaaaaacagcagtttgtgatatagcagaggtttaaatgtaccctccccttttatgcacttcaaataattaaatctctttaagaatgacttctagttgtctgcagttttctgcagttgttgtgatgtttctcttcgtctgatggtggttctggggccaatagagaagaatagtctccagagtacaatttggaatcatcgtggtttggccttgttagtattcaaattcttagaatcccctccatcacccccgactttgagataggatgccaactgtcccagtcctcaccttccattgagaaattaagcttaaaaggagaccctgctgctaatataaagccactgcctttagagagcttttgccatcttagtaagcacaacccctacccccatccccactagtttttcttcttcacctgtgggtggtggtacacagtccctgacaatagcatctttgaggaagtcagatctttgtatctctgagtgagttagaaaaggtaggcatgtgtgtatttgaaccactccctccctggatgagaaccactgatcattttatgtgtgatgatgctgaatttaaagagaatgtcagttgcccaaagctacactgtactactagtaaataacaaagcctgggttttatcttccagttttcctacagtattcctcctaccttgtacaccatcacactactaatgaacacagataacgtttactttccagtttatgcctttgttgtatccctaaaatgactacagactgatgtgatctaaaaaccatgtttcattgtgtgttagctgtgaagctggcctgtaccagagaaacctctgaacttgtaggggaaaatgataaaatgcacatggaaactgacacttcagtttccatctcagtagtcctgcagctttgtgaggtgggagaggggaagggactgtgttaagttagagcctgaaccagaaggagggtcagtgggtaaagaaagaaagggtagatgaggtgtgccttccacctcacctaaatgaatactgtttgttttttgtttttccttccagattagactttgggggatttcttatatagaataaagggcttgattatatgtagcctctatcctggagaaaggttatgtaatttggactatgtaaaggaagttgacttctttacagcttcgtttcagtatcctaggaggtgggattcatttttctatcttaagttaacctaaaggagagatgccacttgtggtgatggaggttgttaaaaacctgaatttccctgcttcattctccagtgaagagcttaagaaaatgaggctttggatattttggcagaagtgtctgaaatgcacctgatttgccattatacccaccatcaaaagcaacatggccctttgggtattagtgcaagattagcctaagaatagagtagatctctacctggaagagggtgaaacatggctctctactgatttgggttgtactctgaaggccctttgtaatgggtttctgcctctttgtatttcacttaaaaaatcttgatggatatttggcagtctgttaagacctgcttctggcttggagcaggtattgattggtatttagtacccatgggtgtttttctgggctcagtcttgcctatgtttcttgccatatgacacataccggaatggattccagatgctatatacctgtaacaggagacagaattggacaacaaggattttaagagtcattgcccattgtaaagcattaagccagagctggttattcattatcagactaactacatactagtccatgctagtgtcagcctatattaaaatagtctttccttgccatagtgctggcgaaaacccaatcccttctgatgaaacattgcttcttgggaagacaagctgaggaaagcaatgaagatcccagtgtcggcctttattgagctatgtatgagggtcagggtccctcaactcctagtgactatgaagcagcagtgtgatggcttcgccctctttgcccctctgtcatcaatcctttgcatgtggctattttaagcttctcagctttcttttgggaggcttcatgtgtaacttattatagaaatgttactgaaaagctgcctaaacaaaaaattgtataaagtaggaatttgtataaagtaatactgttgtaaatccatcttcaagatgtaaagaatcaatttgtaaagtgtatattttcacttctcccttcaaatttatgtgaacaagtttttcatgtttcaatattgcttacataggaatacaccttacgtttttatcagtataaatggaacatttaaaaccagtcaacaacagaacagataatccagctccctgtttgtgttctgggttaattttgcaaggatgaagggctagaaagtggtgagtttcggtgtgtttcttattttcaggataaccggctgcattgcagtagaggaatggaatggtgaggtcatttgacctgttccaggtgagtggaggccaaagaacattctttctgcctccccttggatgggaaaattgagaaattaaaaagttgcctttctgaggaaacaaaagttattttctctatttaaaataaatgtccaaaggcacccctctaaacaccaaaacttttagctcctggcaaacttacctagctagaagttggagaagagtgcggtttcaaaccatgcttcctttctgcccttgccaatacgttctcactgactgtgattctgctgtgaacacacacacacacacaaacacacacacaagccccttctgtgtatgatcaggacaagtagttcaacagttaataaaaaagttaaattattggatgagaaagatatatttaacctaaatcataaatatgtatatccatttaataaacactaaaattgagaaaaattagtttggggatgagggccttcattcataatagccataatgcattatctatgatgtgagcttgattgagcttctttaaaatgcataaagaatttgaacaacaaaagaaa

SEQ ID NO: 150199 - DNA, 542 bp, Homo sapiens
  Payload ID: 9656
  Gene Symbol: KDM5B
  Gene Name: lysine (K)-specific demethylase 5B
  ENST ID: ENST00000602511
  CDS Start-End: 1-234
atctgtaaggtgcggccgccgccggattggcagccaccatttgcatgtgatgttgataaacttcattttacgccacgtatccagagactgaatgaattggagtcccgctctgtcacccagggtggagtgcagcagcattatcctggttcactgcaacctctgcctcctgggttcaagtcattctcctgcctcagcctcccaagtagctgggattacaggcccaaactcgtgtaaaattgaatttcttggaccagattgcaaagtactgggagttacagggaagtactctgaaaattccacatgtggagaggaagatcttggacttatttcagcttaataagttagttgcagaagaaggtggatttgcagttgtttgcaaggatagaaaatggaccaaaattgctaccaagatggggtttgctcctggcaaagcagtgggctcacatatcagagggcattatgaacgaattctcaacccctacaacttattcctgtccggagacagcctaaggtgtttgcagaagccaaacctgaccacagac

SEQ ID NO: 150200 - DNA, 548 bp, Homo sapiens
  Payload ID: 9657
  Gene Symbol: KDM5C
  Gene Name: lysine (K)-specific demethylase 5C
  ENST ID: ENST00000349663
  CDS Start-End: 310-534
agatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcgtcaggcatcccagcacttacccccaccccctggggcttcctcccctgcctcttcctgtaccaggcaggtgtatgagagaggatctacag

SEQ ID NO: 150201 - DNA, 5245 bp, Homo sapiens
  Payload ID: 9657
  Gene Symbol: KDM5C
  Gene Name: lysine (K)-specific demethylase 5C
  Uniprot ID: P41229
  ENST ID: ENST00000375379
  CDS Start-End: 534-5207
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccc

SEQ ID NO: 150202 - DNA, 5122 bp, Homo sapiens
  Payload ID: 9657
  Gene Symbol: KDM5C
  Gene Name: lysine (K)-specific demethylase 5C
  Uniprot ID: P41229
  ENST ID: ENST00000375383
  CDS Start-End: 534-5084
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagagattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccc

SEQ ID NO: 150203 - DNA, 6031 bp, Homo sapiens
  Payload ID: 9657
  Gene Symbol: KDM5C
  Gene Name: lysine (K)-specific demethylase 5C
  Uniprot ID: P41229
  ENST ID: ENST00000375401
  CDS Start-End: 534-5216
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtt

SEQ ID NO: 150204 - DNA, 5677 bp, Homo sapiens
  Payload ID: 9657
  Gene Symbol: KDM5C
  Gene Name: lysine (K)-specific demethylase 5C
  Uniprot ID: P41229
  ENST ID: ENST00000404049
  CDS Start-End: 288-4967
ggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaa

SEQ ID NO: 150205 - DNA, 766 bp, Homo sapiens
  Payload ID: 9657
  Gene Symbol: KDM5C
  Gene Name: lysine (K)-specific demethylase 5C
  ENST ID: ENST00000428012
  CDS Start-End: 306-605
ggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagagttccagctactcaggaggctgaggcaggaggatcacttgagcccaggaggtcaagtctacagtcagccgtgattgcaccactccattccagcttgggcgacagagcaagaccgtctcaaaaaaacaaaaacgaaagaaatgagagtgaggcccagacgagagtgaaactgaactacttggaccagattgccaaattctgggaaatccagggctcctccttaaagattcccaat

SEQ ID NO: 150206 - DNA, 870 bp, Homo sapiens
  Payload ID: 9657
  Gene Symbol: KDM5C
  Gene Name: lysine (K)-specific demethylase 5C
  ENST ID: ENST00000429877
  CDS Start-End: 320-481
tgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggcaggtgtatgagagaggatctacaggaagccttccagactgggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctg

SEQ ID NO: 150207 - DNA, 6096 bp, Homo sapiens
  Payload ID: 9657
  Gene Symbol: KDM5C
  Gene Name: lysine (K)-specific demethylase 5C
  Uniprot ID: P41229
  ENST ID: ENST00000452825
  CDS Start-End: 534-4673
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcgattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatctactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtga

SEQ ID NO: 150208 - DNA, 5472 bp, Homo sapiens
  Payload ID: 9658
  Gene Symbol: KDM5D
  Gene Name: lysine (K)-specific demethylase 5D
  Uniprot ID: Q9BY66
  ENST ID: ENST00000317961
  CDS Start-End: 273-4892
cggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaa

SEQ ID NO: 150209 - DNA, 5134 bp, Homo sapiens
  Payload ID: 9658
  Gene Symbol: KDM5D
  Gene Name: lysine (K)-specific demethylase 5D
  Uniprot ID: Q9BY66
  ENST ID: ENST00000382806
  CDS Start-End: 111-4559
aaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatact

SEQ ID NO: 150210 - DNA, 880 bp, Homo sapiens
  Payload ID: 9658
  Gene Symbol: KDM5D
  Gene Name: lysine (K)-specific demethylase 5D
  ENST ID: ENST00000415360
  CDS Start-End: 1-880
ctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgacc

SEQ ID NO: 150211 - DNA, 4701 bp, Homo sapiens
  Payload ID: 9658
  Gene Symbol: KDM5D
  Gene Name: lysine (K)-specific demethylase 5D
  ENST ID: ENST00000440077
  CDS Start-End: 273-4701
cggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggct

SEQ ID NO: 150212 - DNA, 1336 bp, Homo sapiens
  Payload ID: 9658
  Gene Symbol: KDM5D
  Gene Name: lysine (K)-specific demethylase 5D
  ENST ID: ENST00000447300
  CDS Start-End: 61-1336
ggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccag

SEQ ID NO: 150213 - DNA, 5579 bp, Homo sapiens
  Payload ID: 9658
  Gene Symbol: KDM5D
  Gene Name: lysine (K)-specific demethylase 5D
  Uniprot ID: Q9BY66
  ENST ID: ENST00000541639
  CDS Start-End: 289-5001
cattttaaaaaagatccggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaagagacaaagtctcactgtgttgaccaggctgatctcaagcttctgggctcaagcagtcctcccaccttggcctcccaaagtgttgggattacaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcttatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatg

SEQ ID NO: 150214 - DNA, 5438 bp, Homo sapiens
  Payload ID: 9659
  Gene Symbol: KDM6A
  Gene Name: lysine (K)-specific demethylase 6A
  Uniprot ID: O15550
  ENST ID: ENST00000377967
  CDS Start-End: 42-4247
ggggggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaa

SEQ ID NO: 150215 - DNA, 5789 bp, Homo sapiens
  Payload ID: 9659
  Gene Symbol: KDM6A
  Gene Name: lysine (K)-specific demethylase 6A
  ENST ID: ENST00000382899
  CDS Start-End: 448-4602
gtgacacaattacaacaactttgtgctggtgccggggaagtttgtgtctccaacgaatcccctcagtgctccccagccccgcgcgctccggccgttcccgccgtccccgcctgtggctgccccctgcccaaccccgcgatgtgaccctacagccgaaagccgccgctgccgacccgggggctccgcagcccctgccgccgccgccgccgccttcaccgccgccgcgttgggatttttcgtcgccgccgcccgcggcggaggaggaggcggcgataaagttggtgtgctggtcccgcgcgcagattgggggcgtcactgcgggccccggtccgagggggggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgcc

SEQ ID NO: 150216 - DNA, 4324 bp, Homo sapiens
  Payload ID: 9659
  Gene Symbol: KDM6A
  Gene Name: lysine (K)-specific demethylase 6A
  ENST ID: ENST00000433797
  CDS Start-End: 1-3133
gaataaaactaaattacttcctagtattgaggaggcgtggagcctaccaattcccgcagagcttacctccaggcagggtgccatgaacacagcacagcaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaa

SEQ ID NO: 150217 - DNA, 671 bp, Homo sapiens
  Payload ID: 9659
  Gene Symbol: KDM6A
  Gene Name: lysine (K)-specific demethylase 6A
  ENST ID: ENST00000451692
  CDS Start-End: 1-671
ctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggc

SEQ ID NO: 150218 - DNA, 4189 bp, Homo sapiens
  Payload ID: 9659
  Gene Symbol: KDM6A
  Gene Name: lysine (K)-specific demethylase 6A
  ENST ID: ENST00000414389
  CDS Start-End: 1-2998
aggcactctctatgaatcctgcaaccagcctcaggatgccattaaatgctacttaaatgcaactagaagcaaaagttgtagtaatacctctgcacttgcagcacgaattaagtatttacagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaa

SEQ ID NO: 150219 - DNA, 735 bp, Homo sapiens
  Payload ID: 9659
  Gene Symbol: KDM6A
  Gene Name: lysine (K)-specific demethylase 6A
  ENST ID: ENST00000431196
  CDS Start-End: 1-484
ggcacgaaatatcaaggtctcagatccaaagctttttgaaatgattaagatattttcattgtctccgaattttagagctgaaaagtgccttagagatcatctagttcaacctctccgttcaaatggagaacctgagccactaagattcacaggagagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaa

SEQ ID NO: 150220 - DNA, 5633 bp, Homo sapiens
  Payload ID: 9659
  Gene Symbol: KDM6A
  Gene Name: lysine (K)-specific demethylase 6A
  ENST ID: ENST00000536777
  CDS Start-End: 448-4446
gtgacacaattacaacaactttgtgctggtgccggggaagtttgtgtctccaacgaatcccctcagtgctccccagccccgcgcgctccggccgttcccgccgtccccgcctgtggctgccccctgcccaaccccgcgatgtgaccctacagccgaaagccgccgctgccgacccgggggctccgcagcccctgccgccgccgccgccgccttcaccgccgccgcgttgggatttttcgtcgccgccgcccgcggcggaggaggaggcggcgataaagttggtgtgctggtcccgcgcgcagattgggggcgtcactgcgggccccggtccgagggggggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgcc

SEQ ID NO: 150221 - DNA, 5655 bp, Homo sapiens
  Payload ID: 9659
  Gene Symbol: KDM6A
  Gene Name: lysine (K)-specific demethylase 6A
  ENST ID: ENST00000543216
  CDS Start-End: 448-4257
gtgacacaattacaacaactttgtgctggtgccggggaagtttgtgtctccaacgaatcccctcagtgctccccagccccgcgcgctccggccgttcccgccgtccccgcctgtggctgccccctgcccaaccccgcgatgtgaccctacagccgaaagccgccgctgccgacccgggggctccgcagcccctgccgccgccgccgccgccttcaccgccgccgcgttgggatttttcgtcgccgccgcccgcggcggaggaggaggcggcgataaagttggtgtgctggtcccgcgcgcagattgggggcgtcactgcgggccccggtccgagggggggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgcc

SEQ ID NO: 150222 - DNA, 2876 bp, Homo sapiens
  Payload ID: 9659
  Gene Symbol: KDM6A
  Gene Name: lysine (K)-specific demethylase 6A
  ENST ID: ENST00000621147
  CDS Start-End: 1-675
atgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacagaatacttctgacaattggagtggtggacatgctgtgtcacatcctccagtacagcaacaagctcattcatggtgtttgacaccacagaaattacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttga

SEQ ID NO: 150223 - DNA, 5924 bp, Homo sapiens
  Payload ID: 9659
  Gene Symbol: KDM6A
  Gene Name: lysine (K)-specific demethylase 6A
  ENST ID: ENST00000611820
  CDS Start-End: 448-4737
gtgacacaattacaacaactttgtgctggtgccggggaagtttgtgtctccaacgaatcccctcagtgctccccagccccgcgcgctccggccgttcccgccgtccccgcctgtggctgccccctgcccaaccccgcgatgtgaccctacagccgaaagccgccgctgccgacccgggggctccgcagcccctgccgccgccgccgccgccttcaccgccgccgcgttgggatttttcgtcgccgccgcccgcggcggaggaggaggcggcgataaagttggtgtgctggtcccgcgcgcagattgggggcgtcactgcgggccccggtccgagggggggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacagccgcctctttgggttcgtgagatttcatgaagatggcgccaggacgaaggccctactgggcaaggctgttcgctgctatgaatctctaatcttaaaagctgaaggaaaagtggagtctgatttcttttgtcaattaggtcacttcaacctcttattggaagattatccaaaagcattatctgcataccagaggtactacagtttacagtctgactactggaagaatgctgcctttttatatggtcttggtttggtctacttccattataatgcatttcagtgggcaattaaagcatttcaggaggtgctttatgttgatcccagcttttgtcgagccaaggaaattcatttacgacttgggcttatgttcaaagtgaacacagactatgagtctagtttaaagcattttcagttagctttggttgactgtaatccctgcactttgtccaatgctgaaattcaatttcacattgcccacttatatgaaacccagaggaaatatcattctgcaaaagaagcttatgaacaacttttgcagacagagaatctttctgcacaagtaaaagcaactgtcttacaacagttaggttggatgcatcacactgtagatctcctgggagataaagccaccaaggaaagctatgctattcagtatctccaaaagtccttggaagcagatcctaattctggccagtcctggtatttcctcggaaggtgctattcaagtattgggaaagttcaggatgcctttatatcttacaggcagtctattgataaatcagaagcaagtgcagatacatggtgttcaataggtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggctcagttgtgtaaccttccacaaggtagtctacagaataaaactaaattacttcctagtattgaggaggcgtggagcctaccaattcccgcagagcttacctccaggcagggtgccatgaacacagcacagcaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaagaatacttctgacaattggagtggtggacatgctgtgtcacatcctccagtacagcaacaagctcattcatggtgtttgacaccacagaaattacagcatttggaacagctccgcgcaaatagaaataatttaaatccagcacagaaactgatgctggaacagctggaaagtcagtttgtcttaatgcaacaacaccaaatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggaatctaggtaaaaatggcttatctaacagtagcattttgttggataaatgtccacctccaagaccaccatcttcaccataccctcccttgccaaaggacaagttgaatccacctacacctagtatttacttggaaaataaacgtgatgctttctttcctccattacatcaattttgtacaaatccgaacaaccctgttacagtaatacgtggccttgctggagctcttaagttagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagaagaaaatgaaaaaagaagtcatcataaagaccactcagatagtgaatctacatcgtcagataattctgggaggaggaggaaaggaccctttaaaaccataaagtttgggaccaatattgacctatctgatgacaaaaagtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtcatcaggaaaataacaacttctgttcagttaacataaatattggcccaggtgactgtgaatggtttgttgttcctgaaggttactggggtgttctgaatgacttctgtgaaaaaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgcc

SEQ ID NO: 150224 - DNA, 6713 bp, Homo sapiens
  Payload ID: 9660
  Gene Symbol: KDM6B
  Gene Name: lysine (K)-specific demethylase 6B
  Uniprot ID: O15054
  ENST ID: ENST00000254846
  CDS Start-End: 390-5438
aggttccccccagggcaacatgccagccccgtagcactgcccaccccacccactgtggtctgttgtaccccactgctggggtggtggttccaatgagacagggcacaccaaactccatctggctgttactgaggcggagacacgggtgatgattggctttctggggagagaggaagtcctgtgattggccagatctctggagcttgccgacgcggtgtgaggacgctcccacggaggccggaattggctgtgaaaggactgaggcagccatctgggggtagcgggcactcttatcagagcggctggagccggaccatcgtcccagagagctggggcagggggccgtgcccaatctccagggctcctggggccactgctgacctggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagccctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgcccggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccagggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggtgagggcccggcgggcgcgcgggcagcggaggagggcactggggcaggctgcagggacgggcttcgggagcccggccgcgcctttccctgagcccccgccggctttctccccccaggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaactttttttttttttttagcaaatatgaggaaaaaaggaaaaaaaatgggagacgggggagggggctggcagcccctcgcccaccagcgcctcccctcaccgactttggcctttttagcaacagacacaaggaccaggctccggcggcggcgggggtcacatacgggttccctcaccctgccagccgcccgcccgcccggcgcagatgcacgcggctcgtgtatgtacatagacgttacggcagccgaggtttttaatgagattctttctatgggctttacccctcccccggaacctccttttttacttccaatgctagctgtgacccctgtacatgtctctttattcacttggttatgatttgtattttttgttcttttcttgtttttttgtttttaatttataacagtcccactcacctctatttattcatttttgggaaaacccgacctcccacacccccaagccatcctgcccgcccctccagggaccgcccgtcgccgggctctccccgcgccccagtgtgtgtccgggcccggcccgaccgtctccacccgtccgcccgcggctccagccgggttctcatggtgctcaaacccgctcccctcccctacgtcctgcactttctcggaccagtccccccactcccgacccgaccccagccccacctgagggtgagcaactcctgtactgtaggggaagaagtgggaactgaaatggtattttgtaaaaaaaataaataaaataaaaaaattaaaggttttaaagaaagaactatgaggaaaaggaaccccgtccttcccagccccggccaactttaaaaaacacagaccttcacccccacccccttttctttttaagtgtgaaacaacccagggccagggcctcactggggcagggacaccccggggtgagtttctctggggctttattttcgttttgttggttgttttttctccacgctggggctgcggaggggtggggggtttacagtcccgcaccctcgcactgcactgtctctctgccccaggggcagaggggtcttcccaaccctacccctattttcggtgatttttgtgtgagaatattaatattaaaaataaacggagaaaaaaaa

SEQ ID NO: 150225 - DNA, 5422 bp, Homo sapiens
  Payload ID: 9660
  Gene Symbol: KDM6B
  Gene Name: lysine (K)-specific demethylase 6B
  Uniprot ID: O15054
  ENST ID: ENST00000448097
  CDS Start-End: 332-5263
tctgttgtaccccactgctggggtggtggttccaatgagacagggcacaccaaactccatctggctgttactgaggcggagacacgggtgatgattggctttctggggagagaggaagtcctgtgattggccagatctctggagcttgccgacgcggtgtgaggacgctcccacggaggccggaattggctgtgaaaggactgaggcagccatctgggggtagcgggcactcttatcagagcggctggagccggaccatcgtcccagagagctggggcagggggccgtgcccaatctccagggctcctggggccactgctgacctggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacagactggccttcccccagggctgccactgcctccaccaccattaccaccaccaccaccaccaccaccaccaccaccaccacccctgcctggcctggctaccagccccccatttcagctaaccaagccagggctgtggagtaccctgcatggagatgcctggggcccagagcgcaagggttcagcacccccagagcgccaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcccgcgctggaggtctctcaccatggccgcctggggccctcggcacacagcagtcggaaaccgttcttgggggctcccgctgccactccccacctatccctgccacctggaccttcctcaccccctccacccccctgtccccgcctcttacgccccccaccaccccctgcctggttgaagggtccggcctgccgggcagcccgagaggatggagagatcttagaagagctcttctttgggactgagggacccccccgccctgccccaccacccctcccccatcgcgagggcttcttggggcctccggcctcccgcttttctgtgggcactcaggattctcacacccctcccactcccccaaccccaaccaccagcagtagcaacagcaacagtggcagccacagcagcagccctgctgggcctgtgtcctttcccccaccaccctatctggccagaagtatagacccccttccccggcctcccagcccagcacagaacccccaggacccacctcttgtacccctgactcttgccctgcctccagcccctccttcctcctgccaccaaaatacctcaggaagcttcaggcgcccggagagcccccggcccagggtctccttcccaaagacccccgaggtggggccggggccacccccaggccccctgagtaaagccccccagcctgtgccgcccggggttggggagctgcctgcccgaggccctcgactctttgattttccccccactccgctggaggaccagtttgaggagccagccgaattcaagatcctacctgatgggctggccaacatcatgaagatgctggacgaatccattcgcaaggaagaggaacagcaacaacacgaagcaggcgtggccccccaacccccgctgaaggagccctttgcatctctgcagtctcctttccccaccgacacagcccccaccactactgctcctgctgtcgccgtcaccaccaccaccaccaccaccaccaccaccacggccacccaggaagaggagaagaagccaccaccagccctaccaccaccaccgcctctagccaagttccctccaccctctcagccacagccaccaccacccccaccccccagcccggccagcctgctcaaatccttggcctccgtgctggagggacaaaagtactgttatcgggggactggagcagctgtttccacccggcctgggcccttgcccaccactcagtattcccctggccccccatcaggtgctaccgccctgccgcccacctcagcggcccctagcgcccagggctccccacagccctctgcttcctcgtcatctcagttctctacctcaggcgggccctgggcccgggagcgcagggcgggcgaagagccagtcccgggccccatgacccccacccaaccgcccccacccctatctctgccccctgctcgctctgagtctgaggtgctagaagagatcagccgggcttgcgagacccttgtggagcgggtgggccggagtgccactgacccagccgacccagtggacacagcagagccagcggacagtgggactgagcgactgctgccccccgcacaggccaaggaggaggctggcggggtggcggcagtgtcaggcagctgtaagcggcgacagaaggagcatcagaaggagcatcggcggcacaggcgggcctgtaaggacagtgtgggtcgtcggccccgtgagggcagggcaaaggccaaggccaaggtccccaaagaaaagagccgccgggtgctggggaacctggacctgcagagcgaggagatccagggtcgtgagaagtcccggcccgatcttggcggggcctccaaggccaagccacccacagctccagcccctccatcagctcctgcaccttctgcccagcccacacccccgtcagcctctgtccctggaaagaaggctcgggaggaagccccagggccaccgggtgtcagccgggccgacatgctgaagctgcgctcacttagtgaggggccccccaaggagctgaagatccggctcatcaaggtagagagtggtgacaaggagacctttatcgcctctgaggtggaagagcggcggctgcgcatggcagacctcaccatcagccactgtgctgctgacgtcgtgcgcgccagcaggaatgccaaggtgaaagggaagtttcgagagtcctacctttcccctgcccagtctgtgaaaccgaagatcaacactgaggagaagctgccccgggaaaaactcaacccccctacacccagcatctatctggagagcaaacgggatgccttctcacctgtcctgctgcagttctgtacagaccctcgaaatcccatcacagtgatccggggcctggcgggctccctgcggctcaacttgggcctcttctccaccaagaccctggtggaagcgagtggcgaacacaccgtggaagttcgcacccaggtgcagcagccctcagatgagaactgggatctgacaggcactcggcagatctggccttgtgagagctcccgttcccacaccaccattgccaagtacgcacagtaccaggcctcatccttccaggagtctctgcaggaggagaaggagagtgaggatgaggagtcagaggagccagacagcaccactggaacccctcctagcagcgcaccagacccgaagaaccatcacatcatcaagtttggcaccaacatcgacttgtctgatgctaagcggtggaagccccagctgcaggagctgctgaagctgcccgccttcatgcgggtaacatccacgggcaacatgctgagccacgtgggccacaccatcctgggcatgaacacggtgcagctgtacatgaaggtgcccggcagccgaacgccaggccaccaggagaataacaacttctgctccgtcaacatcaacattggcccaggcgactgcgagtggttcgcggtgcacgagcactactgggagaccatcagcgctttctgtgatcggcacggcgtggactacttgacgggttcctggtggccaatcctggatgatctctatgcatccaatattcctgtgtaccgcttcgtgcagcgacccggagacctcgtgtggattaatgcggggactgtgcactgggtgcaggccaccggctggtgcaacaacattgcctggaacgtggggcccctcaccgcctatcagtaccagctggccctggaacgatacgagtggaatgaggtgaagaacgtcaaatccatcgtgcccatgattcacgtgtcatggaacgtggctcgcacggtcaaaatcagcgaccccgacttgttcaagatgatcaagttctgcctgctgcagtccatgaagcactgccaggtgcaacgcgagagcctggtgcgggcagggaagaaaatcgcttaccagggccgtgtcaaggacgagccagcctactactgcaacgagtgcgatgtggaggtgtttaacatcctgttcgtgacaagtgagaatggcagccgcaacacgtacctggtacactgcgagggctgtgcccggcgccgcagcgcaggcctgcagggcgtggtggtgctggagcagtaccgcactgaggagctggctcaggcctacgacgccttcacgctggccccagccagcacgtcgcgatgaggccggacgccccgcccgcctgcctgcccgcgcaaggcgccgcggggccaccagcacatgcctgggctggacctaggtcccgcctgtggccgagaagggggtcgggcccagcccttccaccccattggcagctcccctcacttaatttattaagaaaaa

SEQ ID NO: 150226 - DNA, 1339 bp, Homo sapiens
  Payload ID: 9660
  Gene Symbol: KDM6B
  Gene Name: lysine (K)-specific demethylase 6B
  ENST ID: ENST00000570632
  CDS Start-End: 255-1339
ggagacacgggtgatgattggctttctggggagagaggaagtcctgtgattggccagatctctggagcttgccgacgcggtgtgaggacgctcccacggaggccggaattggctgtgaaaggactgaggcagccatctgggggtagcgggcactcttatcagagcggctggagccggaccatcgtcccagagagctggggcagggggccgtgcccaatctccagggctcctggggccactgctgacctggctggatgcatcgggcagtggaccctccaggggcccgcgctgcacgggaagcctttgcccttgggggcctgagctgtgctggggcctggagctcctgcccgcctcatccccctcctcgtagcgcatggctgcctggaggcagatgctcagccagcattgggcagcccccgcttcctgctcccctacccccttcacatggcagtagttctgggcaccccagcaaaccatattatgctccaggggcgcccactccaagacccctccatgggaagctggaatccctgcatggctgtgtgcaggcattgctccgggagccagcccagccagggctttgggaacagcttgggcaactgtacgagtcagagcacgatagtgaggaggccacacgctgctaccacagcgcccttcgatacggaggaagcttcgctgagctggggccccgcattggccgactgcagcaggcccagctctggaactttcatactggctcctgccagcaccgagccaaggtcctgcccccactggagcaagtgtggaacttgctacaccttgagcacaaacggaactatggagccaagcggggaggtcccccggtgaagcgagctgctgaacccccagtggtgcagcctgtgcctcctgcagcactctcaggcccctcaggggaggagggcctcagccctggaggcaagcgaaggagaggctgcaactctgaacaggagcagcggcactcgctgcctcacccatatccatacccagctccagcgtacaccgcgcacccccctggccaccggctggtcccggctgctcccccaggcccaggcccccgccccccaggagcagagagccatggctgcctgcctgccacccgtccccccggaagtgaccttagagagagcagagttcagaggtcgcggatggactccagcgtttcaccagcagcaaccaccgcctgcgtgccttacgccccttcccggccccctggcctccccggcaccaccaccagcagcagcagtagcagcagcagcaacactggtctccggggcgtggagccgaacccaggcattcccggcgctgaccattaccaaactcc

SEQ ID NO: 150227 - DNA, 9272 bp, Homo sapiens
  Payload ID: 9661
  Gene Symbol: KDM7A
  Gene Name: lysine (K)-specific demethylase 7A
  Uniprot ID: Q6ZMT4
  ENST ID: ENST00000397560
  CDS Start-End: 99-2924
gccgccgcggctgctgcaggaggcggcgctggctggcggctgcgctcgctccagtcggcgagcggagtagcgagcgagcgtgtgtgtgttttttaaagatggccggagcggcggcggcggtggccgcgggagcagcagctggagccgccgcggcagccgtgtcggtggcggctcccggccgggcctcggcgcctccgccgcccccgcccgtgtactgtgtgtgccggcagccgtacgacgtgaaccgcttcatgatcgagtgcgatatctgcaaggactggttccacggcagctgtgttggagtagaagaacatcatgctgttgacattgacctgtatcactgtcccaactgtgcagttttacatggttcctccttgatgaaaaaaaggaggaactggcacagacatgactacacagaaattgatgatggttccaaaccagtgcaagctggaactagaactttcattaaggaattacgctctcgagtcttcccaagtgccgatgaaataattataaagatgcatggcagccagctgacacaaagatatctggagaaacatggatttgatgtccctattatggtcccaaaattagatgatctaggactcaggctcccttcacctacattttctgtgatggatgtggaacgttatgtaggtggtgacaaagtgatagatgtcattgatgtggcgaggcaggcagacagcaaaatgacacttcacaattatgttaaatacttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacacgtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatgaattaaaattgtggccagtatccactgtgtccttaggctgagaagtactaatttggagtagcccgtgtgtggaattctaaagtgaaggtactgtggattcatttttagtagttttagccccttaataagtggctaagttagaaaactttcagcgaggtaatagaaccacttgaatagaatccatgtgtctttttctgaattggtgaaaattcggccactgatccagtgactcctggtcaaacgtcttataacattactggccataatgcatccctttatctcatggaaatggctgaactttgtggtagctgctgcgagtacctgggcttaacagtaatagagaacctcatttataccatacagacacagcaacttaggaagacagcactgatagcatttagctagttgtaaccaaatacaaatatgtaaaattgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaagcccatctttatcactaattacttagcttgaatacttttctatttttaaataatcctaattattgccttttcaattatagtctactgtatttatttatatgggatcaacaggtatttatcaaacatctactgtgtgcccagcactacctagtactgttggggaacatcaatttgcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaagttctgccatttaggtatcagctgtgtaaccttgaataagtcacttaactctttctcttagttttctcatttgtaaatttggattaaagtgtttattatgataatcaattaagaaaatctcttaacacttcatacatacagagaacttatcattaagttaaaactggcaattaatgcacctttatatatatttttaaatgaaaactaatactattcatgatgtttattttatatcaaatatatgcccagggcatgctactttaaaaatccgaggaatctccaacaaggtgctggattaaaatcagatttcgtgcttgaagtggaagaaaaatgaagttgtttatggataagagagtgagaatgtgtatcctcaagtacgttaagatgatttaactgaaagatggctttaggtttttcttgaagaattaggaaagtaccatccccacagattcagcatactcttcaggtactagataaaggtgaaggaagtcatggaattaaaatgacttagcaactccccagggaacttgtggggagaatgaggtggttagaaaggtgagaatgcacaaagacagctctgggttgggtaccaacagtttgcttggtagaaagaaaccagtgtaggaaaggagacgccaccagacatcttcaacagacaagattctttctgcctttttcaaaagatgctctctgcagcagtaagactatagatagagttgattggaatatcatgtgacccagtatgctactgctaggcataattatcaaaaattcatttttctcattaaatattgttaattgctcgccacataaagagaagctagagctcaccagtcttggtggtgtcctagaccttcctctaaagcagtcttgggaagctggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagaattaattttctcattctgttgctgttgaacgtaatgtaatcttaatactgtagccttcctagaagcccttccctctttttcatgctgtaaagtcaaatatttgatatccttaacataaattttaaaaattaaggtcattaggaagcaaatgtctatttccaaagcaatgagcttgttgtgactgtgattttattcttctatagtatttttttcctcattttaactgagaggagaaaataatactcttttgcaatatccttaggttctccccttccccctggtgccccttctagtgtcttaagactttgtcttaacaagtataacattacattttgttgttaaaacctttcgaaactgtattcagtgattcttccaagtttatctgctctgcactatttcactaataaaccctggctaccacgtagcccttgatctccaagtagtttacctatgcaagacctgtgacactctgaattcacttctctttctttcagaaagtagtcataaatggagcttaattataaaggtaaaacttgtctccaaccagtttcattttggccatttctttttcaaaatgtcagctgttttcctccaagatttttcaccaaaacaatgatcataagtgctggaatatataatactttgcaggcataaaataacccagacatactctcatatttctttggtgtattttggttggtaaaacttaccagcattaaatgtaaaatataatgaggagttaattccttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttcttgttgggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttgatttttttagcacttagtgtattttttgctcattttgtttgaaagtataaatgttgaaaattgtataaaatgcgtccttgaaagaaaaagaatctgaattctatatccaa

SEQ ID NO: 150228 - DNA, 7943 bp, Homo sapiens
  Payload ID: 9661
  Gene Symbol: KDM7A
  Gene Name: lysine (K)-specific demethylase 7A
  ENST ID: ENST00000472616
  CDS Start-End: 1-1214
tagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacacgtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtgagacgaggtctcacctatgttgcccagactggtctccaactcctgagctcaagtgatcctcctgcctctgcttcccaaagtgctgagattacaggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatgaattaaaattgtggccagtatccactgtgtccttaggctgagaagtactaatttggagtagcccgtgtgtggaattctaaagtgaaggtactgtggattcatttttagtagttttagccccttaataagtggctaagttagaaaactttcagcgaggtaatagaaccacttgaatagaatccatgtgtctttttctgaattggtgaaaattcggccactgatccagtgactcctggtcaaacgtcttataacattactggccataatgcatccctttatctcatggaaatggctgaactttgtggtagctgctgcgagtacctgggcttaacagtaatagagaacctcatttataccatacagacacagcaacttaggaagacagcactgatagcatttagctagttgtaaccaaatacaaatatgtaaaattgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaagcccatctttatcactaattacttagcttgaatacttttctatttttaaataatcctaattattgccttttcaattatagtctactgtatttatttatatgggatcaacaggtatttatcaaacatctactgtgtgcccagcactacctagtactgttggggaacatcaatttgcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaagttctgccatttaggtatcagctgtgtaaccttgaataagtcacttaactctttctcttagttttctcatttgtaaatttggattaaagtgtttattatgataatcaattaagaaaatctcttaacacttcatacatacagagaacttatcattaagttaaaactggcaattaatgcacctttatatatatttttaaatgaaaactaatactattcatgatgtttattttatatcaaatatatgcccagggcatgctactttaaaaatccgaggaatctccaacaaggtgctggattaaaatcagatttcgtgcttgaagtggaagaaaaatgaagttgtttatggataagagagtgagaatgtgtatcctcaagtacgttaagatgatttaactgaaagatggctttaggtttttcttgaagaattaggaaagtaccatccccacagattcagcatactcttcaggtactagataaaggtgaaggaagtcatggaattaaaatgacttagcaactccccagggaacttgtggggagaatgaggtggttagaaaggtgagaatgcacaaagacagctctgggttgggtaccaacagtttgcttggtagaaagaaaccagtgtaggaaaggagacgccaccagacatcttcaacagacaagattctttctgcctttttcaaaagatgctctctgcagcagtaagactatagatagagttgattggaatatcatgtgacccagtatgctactgctaggcataattatcaaaaattcatttttctcattaaatattgttaattgctcgccacataaagagaagctagagctcaccagtcttggtggtgtcctagaccttcctctaaagcagtcttgggaagctggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagaattaattttctcattctgttgctgttgaacgtaatgtaatcttaatactgtagccttcctagaagcccttccctctttttcatgctgtaaagtcaaatatttgatatccttaacataaattttaaaaattaaggtcattaggaagcaaatgtctatttccaaagcaatgagcttgttgtgactgtgattttattcttctatagtatttttttcctcattttaactgagaggagaaaataatactcttttgcaatatccttaggttctccccttccccctggtgccccttctagtgtcttaagactttgtcttaacaagtataacattacattttgttgttaaaacctttcgaaactgtattcagtgattcttccaagtttatctgctctgcactatttcactaataaaccctggctaccacgtagcccttgatctccaagtagtttacctatgcaagacctgtgacactctgaattcacttctctttctttcagaaagtagtcataaatggagcttaattataaaggtaaaacttgtctccaaccagtttcattttggccatttctttttcaaaatgtcagctgttttcctccaagatttttcaccaaaacaatgatcataagtgctggaatatataatactttgcaggcataaaataacccagacatactctcatatttctttggtgtattttggttggtaaaacttaccagcattaaatgtaaaatataatgaggagttaattccttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttcttgttgggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttga

SEQ ID NO: 150229 - DNA, 2462 bp, Homo sapiens
  Payload ID: 9662
  Gene Symbol: KDM8
  Gene Name: lysine (K)-specific demethylase 8
  Uniprot ID: Q8N371
  ENST ID: ENST00000286096
  CDS Start-End: 174-1424
gtcgtgatcagacgagcggtgagcgatcgatactcctatgctagcctctggctcctcaggggacacagccgagtggtcggaccaaacgcaacgagtcttcgccagcccaaaggcgactcgacaccgtcccagctgaagagaggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggagtttggagtatatccaggagatcgctggctgccgaactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctctgttttttgttttttaaactaaatagagatgggatcttgctatgtt

SEQ ID NO: 150230 - DNA, 1612 bp, Homo sapiens
  Payload ID: 9662
  Gene Symbol: KDM8
  Gene Name: lysine (K)-specific demethylase 8
  Uniprot ID: Q8N371
  ENST ID: ENST00000441782
  CDS Start-End: 119-1483
agtgcgcctgcgcgggttttatactctgctatatgtgtgtccgctgcttttaggcaaccagccgctgcccctgggccgcaaggcaggctggaaacgattccgccgtcaggtcccaaatatgagccgcgagaaatgcagccccggggaaggcgctgaggagggaagggggtctgaggcctcggggctcaaggccagtgcggggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggagtttggagtatatccaggagatcgctggctgccgaactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtgg

SEQ ID NO: 150231 - DNA, 560 bp, Homo sapiens
  Payload ID: 9662
  Gene Symbol: KDM8
  Gene Name: lysine (K)-specific demethylase 8
  ENST ID: ENST00000562733
  CDS Start-End: 201-560
tactctgctatatgtgtgtccgctgcttttaggcaaccagccgctgcccctgggccgcaaggcaggctggaaacgattccgccgtcaggtcccaaatatgagccgcgagaaatgcagccccggggaaggcgctgaggagggaagggggtctgaggcctcggggctcaaggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctg

SEQ ID NO: 150232 - DNA, 798 bp, Homo sapiens
  Payload ID: 9662
  Gene Symbol: KDM8
  Gene Name: lysine (K)-specific demethylase 8
  ENST ID: ENST00000567735
  CDS Start-End: 1-272
cggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccg

SEQ ID NO: 150233 - DNA, 583 bp, Homo sapiens
  Payload ID: 9662
  Gene Symbol: KDM8
  Gene Name: lysine (K)-specific demethylase 8
  ENST ID: ENST00000569329
  CDS Start-End: 95-583
gagaatgcaatttagctcgtcgccggcctgccctgcgggaggataaagggaaaggttccgcgcgcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccc

SEQ ID NO: 150234 - DNA, 1655 bp, Homo sapiens
  Payload ID: 9662
  Gene Symbol: KDM8
  Gene Name: lysine (K)-specific demethylase 8
  Uniprot ID: Q8N371
  ENST ID: ENST00000568965
  CDS Start-End: 1-663
atggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctggactactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccgaaccatcaccagctcctagaagcctccctcctaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctc

SEQ ID NO: 150235 - DNA, 13655 bp, Homo sapiens
  Payload ID: 9663
  Gene Symbol: KMT2A
  Gene Name: lysine (K)-specific methyltransferase 2A
  Uniprot ID: Q03164
  ENST ID: ENST00000389506
  CDS Start-End: 1-11910
atggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcc

SEQ ID NO: 150236 - DNA, 1098 bp, Homo sapiens
  Payload ID: 9663
  Gene Symbol: KMT2A
  Gene Name: lysine (K)-specific methyltransferase 2A
  ENST ID: ENST00000392873
  CDS Start-End: 1-1098
gatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattct

SEQ ID NO: 150237 - DNA, 4320 bp, Homo sapiens
  Payload ID: 9663
  Gene Symbol: KMT2A
  Gene Name: lysine (K)-specific methyltransferase 2A
  ENST ID: ENST00000531904
  CDS Start-End: 4-4320
aacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagagctaacaacacagatcccatgtagttggagaaccaaaggccacatacatgacaaaaagactgaaccgttcaggttacttgcatggagttggtgcttaaatgatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaag

SEQ ID NO: 150238 - DNA, 481 bp, Homo sapiens
  Payload ID: 9663
  Gene Symbol: KMT2A
  Gene Name: lysine (K)-specific methyltransferase 2A
  ENST ID: ENST00000527869
  CDS Start-End: 1-481
gcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagagctaacaacacagatcccatgtagttggagaaccaaaggccacatacatgacaaaaagactgaaccgttcaggttacttgcatggagttggtgcttaaatgatgagcaattcttaggttttggctcagatgaagaagtcagagtgcgaagtcccacaaggtctccttcaggctccatgttggctcaggcagacaagcttccaatgactgacaagagggttgccagcctcctaaaaaaggccaaagctcagctctgcaagattgagaagagtaagagtcttaaacaaaccgaccagccca

SEQ ID NO: 150239 - DNA, 499 bp, Homo sapiens
  Payload ID: 9663
  Gene Symbol: KMT2A
  Gene Name: lysine (K)-specific methyltransferase 2A
  ENST ID: ENST00000532204
  CDS Start-End: 1-264
gcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggttcctcaacttaaaagggatgaggagaccttggagacggttctgaggagactcaaaagatgattatatgattggaagtcagtcctatgaggaaaggttgagagaatgaaagcccatcttcccagaaggaaagatgtaacctgacttttgcgccagaataagaacaacaaacggaagaaaaaaactgagttttatagtagaagtttgtagttgaatgagcatgtagctcaaaatgaagttaaccacttaaacttgtcatatgggggaccaaaatttcttataataaaaagaactatat

SEQ ID NO: 150240 - DNA, 3323 bp, Homo sapiens
  Payload ID: 9663
  Gene Symbol: KMT2A
  Gene Name: lysine (K)-specific methyltransferase 2A
  ENST ID: ENST00000529852
  CDS Start-End: 1-264
gcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggttcctcaacttaaaagggatgaggagaccttggagacggttctgaggagactcaaaagatgattatatgattggaagtcagtcctatgaggaaaggttgagagaatgaaaggttaagaggcaacttaataactcttcaaaaaacatgaatggatccattattaggaatggtaaccagcggtttcccagctccactgacagcagaataagagaaaataggtttaaaccgaaatcaggagtagttgtgtaaagaacttattggtaatgatggttgtcattacagtcatggtaaaaaggttaccaaaataattttattatcttctctggaagtatattttaaaagtacagtcctgcctacatatgtataaaatgacctcttaagctaccttttccttctgtgaatcagtaaataaattcttattcagctcctcgaagcaataattactttccagtaggaagcttccagagatatttctttaggaagtaatggtttttgtagtggctttataggagaatacaaatttttaagtggagctaagagagaaatcttaaacatcaagagaaaccaaggaaaacagtaggtgtggtatcaatataggaaacaaataagtatttgtagcttttatgtccattttcagttgtcatttaaagaggtatagttcagaatagctcttgttaaggctgtcactgcttgtggatacattgtaacaaatgcttataaatcatttccaaactaatagaagtttgcttcatgttagttagtattataaaagcctctgacccttggcttttgaggctgtgtagagggcttgcatcactcagaatgaaacctttttagatatgttgggttgcagaaagcatttcctgtacagtcagaatgaaaacttgaattgggattattcatatagattaccaaaagtctgggcagagctgatattaccaccagccagttttcctactaactcttaactccaaaaccttcattgggttattgaagctttaggacttttgaatttcctactggaattgtgtatgaattccttctttcaagtgaactgatactagatttatttaagattagttatacatcttaagtattttttaagtggcatataatgaatggtctctacttttaaccagtctcataaaatgcctggggttcataggtgaagctggattgttgcaggaattctgcaattgttggcaaagcgaagggcagtttgactccttaattataaagttggatgtcatttgagaaactctgggaattggaagtagaacaaattcatactttccctataacttttaatttcttgtcatacattcagaaaacaagagatgtaaaattcataaaactgcttgtataaattcagaaaacgggattataaaagcaaagacaaattgtcttacgattctttgttctacttgagagattcaagtgttggagtaataaaaaataccagggactttcttttttttaataggttaatgccacctaatgtgggcttctcagaatgtgatggcaaacttccaaatatgatgtgggagccaaaagagaccaactggttttacaaaatattaagaacacaaaatttcccaactcatatatttgaatattcctaaaaaataataagtcaaaattgtgttggtgggctgggcacagtggctcacaactgtaataccagcactgtgggaggctgaggtgggaggattgcttaaggccaggagttcaagactagcctgggcaacttggtaagacctgatctctacaaaataaaaattttaaatttaaaaaattaaaaaaaaaaaattagccaagcatggtggcctggcgccttgtagtcccagctactcaggaagctgtgatgggaggattgcttgagcccaatgggtcgaggctgcagtgagccatgatcatgacactgcactccagcctgggcaacagagtgagactccatctcaaaaaaaaaaaaaaaaaagagaaaaaaaattgcattggccaacttggaggcttcagtgttattttgccaagaagaatgttcacttttgtcatctaattttacactgctccttcagcaaactgactttatggagagataaccctgtttacctttagaaagaaggaagttgtggattcctcagtcttactcccattactattggtcattcaacagcccatcttcccagaaggaaagatgtaacctgacttttgcgccagaataagaacaacaaacggaagaaaaaaactgagttttatagtagaagtttgtagttgaatgagcatgtagctcaaaatgaagttaaccacttaaacttgtcatatgggggaccaaaatttcttataataaaaagaactatatctgaaaataaagttggtgtttgtttaatttttctagcctattcaaatcaatctggtcatttatggtactttcctattagagaaaaataaaccctgtgattgtgatgcttaacttaattttctacagtgaatcagttaagtgggcttattttttctgctttagcaagtagataaaccagttcagacttggaacctgaggattctggaaatacacctttcttgagtttttggtttttttttttaaagattctgcagaataatttgggacattgccaggaatcagaatagtttactatctgaagtagtgcattcattttgctgttttttgtttttttgtttttaagacagataagctactttatgactacctctttttctgaagcagggtgggtggaggtcacctgtctcatttgctttgctgttttcagcatctttgctgcttattcttgttgacatggagtggggatgaggggtactacctatttctctagttacaaagtgagtagcatttgtgtttcttaggtgacagttgctaggtagaattgaattaaatatttgaaaactggacttcattcttgtgtgggtgaaatttttaccttctgttgttattgaagaacagagaattattgtcttagcgctctttaatcccaagtgacctttttgtgttaacatttctcaatatcaggcagagatcatatttaaacagtttcaatctcttcctatctgttatgcattcaaataatcattgttctcttgatgcacc

SEQ ID NO: 150241 - DNA, 804 bp, Homo sapiens
  Payload ID: 9663
  Gene Symbol: KMT2A
  Gene Name: lysine (K)-specific methyltransferase 2A
  ENST ID: ENST00000533790
  CDS Start-End: 1-804
gcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcaggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaag

SEQ ID NO: 150242 - DNA, 16602 bp, Homo sapiens
  Payload ID: 9663
  Gene Symbol: KMT2A
  Gene Name: lysine (K)-specific methyltransferase 2A
  Uniprot ID: Q03164
  ENST ID: ENST00000534358
  CDS Start-End: 24-11942
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcaggtacagaagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgca

SEQ ID NO: 150243 - DNA, 8469 bp, Homo sapiens
  Payload ID: 9664
  Gene Symbol: KMT2B
  Gene Name: lysine (K)-specific methyltransferase 2B
  Uniprot ID: Q9UMN6
  ENST ID: ENST00000420124
  CDS Start-End: 1-8148
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttgga

SEQ ID NO: 150244 - DNA, 16862 bp, Homo sapiens
  Payload ID: 9665
  Gene Symbol: KMT2C
  Gene Name: lysine (K)-specific methyltransferase 2C
  Uniprot ID: Q8NEZ4
  ENST ID: ENST00000262189
  CDS Start-End: 220-14955
gaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaaacctcgaagtagggggaaaactgcagtggaagatgaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttgtctcagggagcacagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaaccagttatgaaatcagtaccaaccaatggctggaaatgcaaaaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtgggttcacctagagtgtgacaaaccaacagatcatgaactggatactcagctcaaagaagagtatatctgcatgtattgtaaacacctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctataa

SEQ ID NO: 150245 - DNA, 16858 bp, Homo sapiens
  Payload ID: 9665
  Gene Symbol: KMT2C
  Gene Name: lysine (K)-specific methyltransferase 2C
  Uniprot ID: Q8NEZ4
  ENST ID: ENST00000355193
  CDS Start-End: 220-14955
gaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaaacctcgaagtagggggaaaactgcagtggaagatgaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttgtctcagggagcacagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaaccagttatgaaatcagtaccaaccaatggctggaaatgcaaaaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtgggttcacctagagtgtgacaaaccaacagatcatgaactggatactcagctcaaagaagagtatatctgcatgtattgtaaacacctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatct

SEQ ID NO: 150246 - DNA, 11186 bp, Homo sapiens
  Payload ID: 9665
  Gene Symbol: KMT2C
  Gene Name: lysine (K)-specific methyltransferase 2C
  ENST ID: ENST00000360104
  CDS Start-End: 1-7324
agagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagaggtaagagtgtgagagattgcatctgccatgttgttcagatcctgggcgaatagttccctcctcacacaggtcacttactcacttgtttcccaattctttgttgtgataaaaactctgtccataataggccagatgttcccaccctgcagtatctcacccttcaggcactccagttcaccttcctccacatggcagctctgtgagcatttgctgtcacctctcccttcccttctgtgccacgggttcagcatccccatggcacccaggtggtatcatttctgtgtgccataggatccttctttatccccttaacctggacacagtttggcagtgtcccctctgaagagcatccccgtccttctccaagggggccgtggctcctgagatggcactgttgggctgtgggcggcaaatctgggccgccgtgctgctgaggattgtgtgctcacgctggcgatcagtgtgtgcttaaccaagtgcccacatcgccacattcttcagcagttcaggtgtgggttgttgtcttcaaaatgccgagtgccaagcttgctgtttgtctccgtgctctcagaggtgactctggtccggcggctcacccattgggattatttttggccttaattgctgcatttgcttcccaccttggtctttcccactgtgattcaggtaccttggttctggaattggcatttcctggaaagctgtcactgagcagcaggcttggtttctgtaggaaacgtcccgcatttggggagtgaggcacctgagtgacttgactttgttggtgctcctctcccttcgtgaacatagccatgggattcgtgggattctatctgtattttgggtctttgtggaatctcctttcttagtcaagaataaggatccgactagacccaaggcccgttatacatctcaaagtaacgtgtaaataagacagtgtgtgggagccctggcacagtgccagtaaccaatggctaccatggtggtcagaagagactcagcccagggccacctgcctccttcctacttgagtattcttgagtaaatagtttaatatgagcccctattttatcttctgcaagatagagaaaatgacttccttaccaggctcttggaaggactcagcagatacctgaaagaaagcagtggaatcattgccaagaacagctgctcaataaacactggtttccttcctttctgtgtagaaggtctttccagctagcgtctagaatcatttcactcagaagagacctagaaattcctgggcctccccttcattttgcagcatcggctctctctggggtggtgggggttgcagggccgcgcactgaggcttgtaccgtgggactcacgcagactcccacctaccttgattggtctgagatgttaatttggtgacctctaaatagaaagacatcctttcagtcttgagtgaggaaaaatgaaggagggaaaacagagttagctggcagttcatctcacccagaattgcatgccccattcagtaaatcaggggaggtgaaaggcttctgggttttagggagagggctaggaaagcagttgcccttccagtcccctccatccacttgcagggacagcattatgagaagtcacagaaatacagctttctctggtcaggctcccgttctcagatctcgctgtttaaaaatactgcctccctcatttcctctgtgcaagcacaatgcctcttttcagggttcccccagggtcccatggaacctcaataaatcaggtcttccttaatttacgtctgtttcgtttgctggttttaaaatgcaagggagatggaggcagaaacgctattgccttccttgctgtcctttcttaccctgtgtctttgccgtgggcagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctataagag

SEQ ID NO: 150247 - DNA, 682 bp, Homo sapiens
  Payload ID: 9665
  Gene Symbol: KMT2C
  Gene Name: lysine (K)-specific methyltransferase 2C
  ENST ID: ENST00000418673
  CDS Start-End: 1-682
ttcctctgctggaaacatcatgccaacaacttacatctcagtcactccaaaaattggcatgggtaaaccagctattactaagagaaaattttctcctggtagacctcggtccaaacagggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcag

SEQ ID NO: 150248 - DNA, 710 bp, Homo sapiens
  Payload ID: 9665
  Gene Symbol: KMT2C
  Gene Name: lysine (K)-specific methyltransferase 2C
  ENST ID: ENST00000418061
  CDS Start-End: 1-710
acaaaggataataaactagttgagaagcagaacccagctgaaggactgcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaa

SEQ ID NO: 150249 - DNA, 479 bp, Homo sapiens
  Payload ID: 9665
  Gene Symbol: KMT2C
  Gene Name: lysine (K)-specific methyltransferase 2C
  ENST ID: ENST00000452749
  CDS Start-End: 14-479
cctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaaacctcgaagtagggggaaaactgcagtggaagatgaggacagcatggatgggctggagacaacagaaacagaaacgattgtggaaacagcagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaa

SEQ ID NO: 150250 - DNA, 5874 bp, Homo sapiens
  Payload ID: 9665
  Gene Symbol: KMT2C
  Gene Name: lysine (K)-specific methyltransferase 2C
  ENST ID: ENST00000424877
  CDS Start-End: 1-4575
ctcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatt

SEQ ID NO: 150251 - DNA, 16862 bp, Homo sapiens; identical to SEQ ID NO: 150244
  Payload ID: 9665
  Gene Symbol: KMT2C
  Gene Name: lysine (K)-specific methyltransferase 2C
  ENST ID: ENST00000558084
  CDS Start-End: 220-2699

SEQ ID NO: 150252 - DNA, 538 bp, Homo sapiens
  Payload ID: 9665
  Gene Symbol: KMT2C
  Gene Name: lysine (K)-specific methyltransferase 2C
  ENST ID: ENST00000558665
  CDS Start-End: 1-538
gtgttttcacctgggtcctctaactcacgaccaccatctccaatggatccatatgcaaaaatgcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcattttt

SEQ ID NO: 150253 - DNA, 19419 bp, Homo sapiens
  Payload ID: 9666
  Gene Symbol: KMT2D
  Gene Name: lysine (K)-specific methyltransferase 2D
  Uniprot ID: O14686
  ENST ID: ENST00000301067
  CDS Start-End: 1-16614
atggacagccagaagctggctggtgaggataaagattcagaaccggcagctgatggacctgcagcttctgaggacccaagtgccactgagtcagacctgcccaacccacatgtgggagaggtctctgtccttagttctgggagtcccaggcttcaggagactcctcaggactgcagtgggggtccggtgcggcgttgtgctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccagatccccttcctcctccactctcacccatcatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagactgagaaagtttcagaacctgaatgcccagccttggaacccagtgccaccagtcctctcccttccccaatgggggacctttcctgccccgcccccagccctgccccagccctggatgacttctctggcctaggggaagacacagcccctctggatgggattgatgctccgggttcacagccagagcctggacagacccctggcagtttggctagtgaacttaaaggctcccctgtgctcctggaccccgaggagctggcccctgtgacccctatggaggtctaccccgaatgcaagcagacagcagggcagggctcaccatgtgaagaacaggaagagccacgtgcaccggtggcccccacaccacccactctcatcaaatccgacatcgttaacgagatctctaatctgagccagggtgatgccagtgccagttttcctggctcagagcccctcctgggctctccagacccggaggggggtggctccctgtccatggagttgggggtctctacggatgttagtccagcccgagatgagggctccctacggctctgtactgactcactgccagagactgatgactcactattgtgcgatgctgggacagctatcagcggaggcaaagctgagggggagaaggggcggcggcgcagctccccagcccgttcccgcatcaaacagggtcgcagcagcagtttcccaggaagacgccggcctcgtggaggagcccatggaggacgtggtagaggacgggcccggctaaagtcaactgcttcttccattgagactctggtagttgctgacattgatagctctcccagtaaggaggaggaggaagaagatgatgacaccatgcagaataccgtggttctcttctccaacacagacaaatttgtcctaatgcaggacatgtgtgtggtatgtggcagctttggccggggggcagagggccacctccttgcctgttcgcagtgctctcagtgctatcacccttactgtgtcaacagcaagatcaccaaggtgatgctgctcaagggctggcgttgtgtggagtgtattgtgtgtgaggtgtgtggccaggcctccgacccctcacgcctgctgctctgtgatgactgtgatattagctaccacacatactgcctggaccccccactgctcaccgtccccaagggcggctggaagtgcaagtggtgtgtgtcctgtatgcagtgtggggctgcttcccctggcttccactgtgaatggcagaatagttacacacactgtgggccctgtgccagcctggtgacctgccctatctgtcatgctccttacgtagaagaggacctactaatccagtgccgccactgtgaacggtggatgcatgcaggctgtgagagcctcttcacagaggacgatgtggagcaggcagccgatgaaggctttgactgtgtctcctgccagccctacgtggtaaagcctgtggcgcctgttgcacctccagagctggtgcccatgaaggtgaaagagccagagccccagtactttcgcttcgaaggtgtgtggctgacagaaactggcatggccttgctgcgtaacctgaccatgtcaccactgcacaagcggcgccaacggcgaggacggcttggcctcccaggcgaggcaggattggagggttctgagccctcagatgcccttggccctgatgacaagaaggatggggacctggacaccgatgagctgctcaagggtgaaggtggtgtggagcacatggagtgcgaaattaaactggagggccccgtcagccctgatgtggagcctggcaaagaggagaccgaggaaagcaaaaaacgcaagcgtaaaccatatcggcctggcattggtggtttcatggtgcgacagcggaaatcccacacacgcacgaaaaaggggcctgctgcacaggcggaggtgttgagtggggatgggcagcccgacgaggtgatacctgctgacctgcctgcagagggcgccgtggagcagagcttagctgaaggggatgagaagaagaagcaacagcggcgagggcgcaagaagagcaaactggaggacatgttccctgcttacttgcaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggagatgatggtccagatattgcagatgaagaatcccgtggcctcgagggcaaagccgatacaccaggacctgaggatgggggcgtgaaggcatccccagtgcccagtgaccctgagaagccaggcaccccaggtgaagggatgcttagctctgacttagacaggatttccacagaagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtggactccctttgggcaatctgccctccagcagcccaatggactcctacccaggcctctgccagtccccgttcctggattctagggagcgcgggggcttctttagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcacctgtgctctatgccaacattaattttcctaatctcaagcaagactacccagactggtcaagccgttgcaaacaaatcatgaagctctggagaaaggttccagcagctgacaaagccccctacctgcaaaaggccaaagataaccgggcagctcaccgcatcaacaaggtgcagaagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagtgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccattcctcaaaccccgctgcccctcgctggataacttggctgtgcctgagagccctggggtagggggaggcaaagcttccgagcccctgctctcgcccccaccttttggggagtcccggaaggccctagaggtgaagaaggaagagcttggggcatcctctcctagctatgggcccccaaacctgggctttgttgactcaccctcctcaggcacccacctgggtggcctggagttaaagacacctgatgtcttcaaagcccccctgacccctcgggcatctcaggtagagccccagagcccgggcttgggcctaaggccccaggagccaccccctgcccaggctttggcaccttctcctccaagtcacccagacatctttcgccctggctcctacactgacccatatgctcagcccccattgactcctcggccccaacctccgccccctgagagctgctgtgctctgccccctcgctcactgccctccgaccctttctcccgagtgcctgccagtcctcagtcccagtccagctcccagtctccactgacaccccggcctctgtctgctgaagctttttgcccatcacccgttacccctcgcttccagtcccctgacccttattctcgcccaccctcacgccctcagtcccgtgacccatttgccccattgcataagccaccccgaccccagccccctgaagttgcctttaaggctgggtctctagcccacacttcgctgggggctggggggttcccagcagccctgcccgcggggccagcaggtgagctccatgccaaggtcccaagtgggcagccccccaattttgtccggtcccctgggacgggtgcatttgtgggcaccccctctcccatgcgtttcactttccctcaggcagtaggggagccttccctaaagccccctgtccctcagcctggtctcccgccaccccatgggatcaacagccattttgggcccggccccaccttgggcaagcctcaaagcacaaactacacagtagccacagggaacttccacccatcgggcagccccctggggcccagcagcgggtccacaggggagagctatgggctgtccccactacgccctccgtcggttctgccaccacctgcacccgacggatccctcccctacctgtcccatggagcctcacagcgatcaggcatcacctctcctgtcgaaaagcgagaagacccagggactggaatgggtagctctttggcgacagctgaactcccaggtacccaggacccaggcatgtccggccttagccaaacagagctggagaagcaacggcagcgccagcgactacgagagctgctgattcggcagcagatccagcgcaacaccctgcggcaggagaaggaaacagctgcagcagctgcaggagcagtggggcctccaggcagctggggtgctgagcccagcagccctgcctttgagcagctgagtcgaggccagaccccctttgctgggacacaggacaagagcagccttgtggggttgcccccaagcaagctgagtggccccatcctggggccagggtccttccctagcgatgaccgactctcccggccacctccaccagccacgccttcctctatggatgtgaacagccggcaactggtaggaggctcccaagctttctatcagcgagcaccctatcctgggtccctgcccttacagcagcaacagcaacaactgtggcagcaacaacaggcaacagcagcaacctccatgcgatttgccatgtcagctcgctttccatcaactcctggacctgaacttggccgccaagccctaggttccccgttggcgggaatttccacccgtctgccaggccctggtgagccagtgcctggtccagctggtcctgcccagttcattgagctgcggcacaatgtacagaaaggactgggacctgggggcactccgtttcctggtcagggcccacctcagagaccccgtttttaccctgtaagtgaggacccccaccgactggctcctgaagggcttcggggcctggcggtatcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaaaacctggagaccaatgacccccacttggatgacctgctcaatggagacgagtttgacctgctggcatatactgatcctgagctggacactggggacaagaaggatatcttcaatgagcacctgaggctggtagaatcggctaatgagaaggctgaacgggaggccctgctgcggggggtggagccaggacccttgggccctgaggagcgccctccccctgctgctgatgcctctgaaccccgcctggcatctgtgctccctgaggtgaagcccaaggtggaggagggtggacgccacccttctccttgccaattcaccattgctacccccaaggtagagcccgcacctgctgccaattcccttggcctggggctaaagccaggacagagcatgatgggcagccgggatacccggatgggcacagggccattttctagcagtgggcacacagctgagaaggcctcctttggggccacgggaggaccaccagctcacctgctgacccccagcccactgagtggcccaggaggatcctccctgctggaaaagtttgagctcgagagtggggctttgaccttgcctggtggacctgcagcatctggggatgagctagacaagatggagagctcactggtagccagcgagttacccctgctcattgaggacctgttggagcatgagaagaaggagctgcagaagaagcagcagctttcagcacagttgcagcctgcccagcagcagcagcaacagcagcagcagcattccctactgtctgcaccaggccctgcccaggccatgtctttgccacatgagggctcttctcccagtttggctgggtcccaacagcagctttccctgggtcttgcaggtgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacagacctggacaaatttgctgcagaagatatcattgatcccattgcaaaggccaagatggtggctttgaaaggcatcaagaaagtgatggctcagggcagcattggggtggcacctggtatgaacagacagcaagtgtctctgctagcccagaggctctcggggggacctagcagtgatctgcagaaccatgtggcagctgggagtggccaggagcggagtgctggtgatccctcccagcctcgtcccaacccgcccacttttgctcagggagtgatcaatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcccaacagcagcaacagcaacattctggtggggctggatccctggctggcccttcagggggcttcttccctggcaaccttgctcttcgaagcctcggacctgattcaaggcttttacaggaaaggcagctgcagctgcagcagcaacgtatgcagctggcccagaaactgcagcagcagcagcagcagcaacagcagcagcagcaccttctaggacaggtggcaatccagcagcaacagcagcagggtcctggagtacagacaaaccaagctctgggtcccaagccccagggccttatgcctcccagcagccaccaaggcctcctggtccagcagctgtcccctcaaccaccccaggggccccagggcatgctgggccctgcccaggtggctgtgttgcagcagcagcaccctggagctttgggcccccagggccctcacagacaggtgcttatgacccagtcccgggtgctcagttccccccagctggcacagcagggtcagggccttatgggacacaggctggtcacagcccagcagcagcagcagcaacaacagcaccaacagcaagggtccatggcagggctgtcccatcttcagcagagtctgatgtcacacagtgggcagcccaaactgagcgctcagcccatgggctctttacagcagcttcagcagcagcagcagctgcaacagcaacagcaacttcagcagcagcagcagcagcagctacaacagcaacagcaacttcagcagcaacagcttcaacagcagcaacagcagcagcagcttcaacaacagcagcagcaacagcttcaacagcagcaacagcagctacaacagcaacagcaacaacaacagcagcagtttcaacagcagcagcaacagcagcagatgggccttttaaaccagagtcgaactttactgtctcctcagcaacaacagcagcagcaagtggcacttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcaggcagtacgccagaccccaccctaccaggagcctgggacccagacctctcccctccagggcctcctgggctgccaacctcaacttgggggcttccctggaccacagacaggccccctccaggagctaggggcagggcctcgacctcagggcccaccccggctccctgccccaccaggagccttatctacaggaccagtccttggccctgtccatcccacacctccaccatccagccctcaagagccaaagagaccttcacaattaccttcccccagctcccagcttcccactgaggcccagctccctcccacccatccagggacccccaaacctcaggggccaaccttggagccgcctcctgggagggtctcacctgctgctgcccagcttgcagataccttgtttagcaagggtctgggaccttgggatcccccagacaacctagcagaaacccagaagccagagcagagcagcctggtacctgggcatctggaccaggtgaatggacaggtggtgcctgaggcatcccaactcagcatcaagcaggaacctcgggaagagccatgtgccctgggagcccagtcagtgaagagggaggccaatggggagccaataggggcaccaggaaccagcaaccacctcctgctggcaggccctcgctcagaagctgggcatctgctcttgcagaagctactccgggcaaagaatgtgcaactcagcactgggcgggggtccgaggggctgcgagctgagatcaacgggcacattgacagcaagctggctgggctggagcagaaactacagggtacccccagcaacaaggaggatgcagcagcaaggaagcctttgacaccgaagcccaagcgggtacagaaggcaagcgacaggttggtgagctcccgaaagaagctgcggaaggaggacggggtcagggccagcgaggccttgctgaaacagctgaaacaggagctgtccctgctgcccctaacggagcctgctatcaccgccaattttagcctctttgccccctttggcagtggctgcccagtcaatgggcagagccagctgaggggggcctttggaagtggggcgctgcccactggccctgactactattcccagctgcttaccaagaataacctgagtaacccgccgacaccaccctcgtcgctgccccccaccccacccccatcggtgcagcagaagatggtgaatggcgtcaccccatctgaagagctgggggagcaccccaaggatgctgcctctgcccgggatagtgaaagggcactgagggatacttcagaggtgaagagtctagacctgctggctgccttgcctacaccccctcacaatcagactgaggatgtcaggatggagagtgatgaggatagcgattctcctgacagcattgtgccagcttcatcccctgagagcatcttgggggaggaggcccctcgtttccctcatctgggctcaggccggtgggagcaagaggaccgggccctctcccctgtcatccccctcattcctcgggccagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagccaagaacctgaatggcgtgatggtggcagtggcggagctgctgagcatgaagatccccaactcctatgaggtgctgttcccagagagccccgcccgggcaggcactgagccaaagaagggggaagctgagggtcctggtgggaaggaaaagggtctggaaggcaagagcccagacactggccctgattggctgaagcagtttgatgcagtgttgcctggctataccctgaagagccaactagacatcttgagcctcctgaaacaggagagccccgccccagagccacccactcagcacagctatacctacaatgtctccaatctggatgtgcgacagctctcggccccacctcctgaagaaccctccccgcccccttcccccttggcaccttctcctgccagtccccctactgagcccttggttgaacttcccaccgaacccttggctgagccacccgtcccctcacctctgccactggcctcatcccctgaatcagcccgacccaagccccgtgcccggccccctgaagaaggtgaagattcccgtcctcctcgcctcaagaaatggaaaggagtgcgctggaagcggcttcggctgctgctgaccatccagaagggcagtgggcggcaggaggatgagcgggaagtggcagagtttatggagcagcttggcacagccttgcgacctgacaaggtaccgcgagacatgcgtcgctgctgtttctgtcatgaggagggtgacggggccactgatgggcctgcccgtctgctgaacctggacctggacctgtgggtgcacctcaactgtgccctttggtccacggaggtgtatgagacccagggcggggcactgatgaatgtggaggttgccctgcaccgaggactgctaaccaagtgctccctgtgccagcgaactggtgccaccagcagctgcaatcgcatgcgttgccccaatgtctaccattttgcttgtgccatccgtgccaagtgcatgttcttcaaggacaagaccatgctgtgtccaatgcataagatcaaggggccctgtgagcaagagctgagctcttttgctgtcttccggcgggtctacattgagcgggacgaggtgaagcaaatcgctagcatcattcagcggggagaacggctgcacatgttccgtgtggggggccttgtgttccacgccatcggacagctgctgcctcaccagatggctgactttcatagtgccactgccctctatcccgtgggctacgaggccacgcgcatctattggagcctccgcaccaacaatcgtcgctgctgctatcgctgttctattggtgagaacaacgggcggccggagtttgtaatcaaagtcatcgagcagggcctggaggacctggtcttcactgacgcctctccccaggccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcactgcccggggtggagagctgtcaaaactatttattccgctatgggcgccacccccttatggagctgccactcatgatcaaccccactggctgtgcccgatcagagcctaaaatcctcacacactacaaacggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcagaatcgaggcatctacatgttccgaataaacaatgaacatgtgattgatgctacgttgaccggcggccctgccaggtacattaaccattcctgtgcccctaactgtgtggccgaagtcgtgacatttgacaaagaggacaaaatcatcatcatctccagccggcgaatccccaaaggagaggagctaacctatgactatcagtttgattttgaggacgatcagcacaagatcccctgccactgtggagcctggaattgtcggaaatggatgaactaagaagctttgaggctaccaggcaggggagtccccctacccacaacctcttccctgaaagggatgagggggaagagaggtagcagccagagccaggacccagggttggggctgccggctgacccggagcccctggagcaggaggctggggcagagggccctaggccaagcccaccctgggcaccagggacaatcctcttccccaccaccggccctcaggctggcatctctgcccccagctccaggaggggccagacagaagcagccattgggcatctcaggtttgagggggatatgggccgggaactacccagaagcatctgggaggcagcagggtgggggaagaggatgtgtggccgggcctcacagccctgctgctcccactgacctctccggcccaactcacggctgcaaagagacttgactaagcttgacaatcccaaaggccgggtcccacacctggccctgcctgccgggtcctgcccccaccctcacccccatccccctccctcttgatctgtctctgtttccctcttttcctctgtgtttctgtctctctatgggttgtgtttccttgttttccactctgacaaatgcaacatgaacgggaaagaggcgcccagctgcctaggagggcaagctgggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggggggtagggtgagggctatccctgagtggcatgcccatacctagtgaggcagggtgtggcccggagctcccactttccctcagtcaccaaactgctgctggtctggtgggaaggggtggtgatgtgggggtgggggagcttagtgtcagcgcggggagggtggggggtatttatctatttatacatgggattgtacatagtcttgtggggcatgggggagccggctggaggtgagaaccctcccctctccccccaccccccggggagagcaaatgtaaaactactaatttttgtgctttatatattctatataaatatatctattttctttttacaaaaccagtttataaatggtaggggggtgtggggcggacacatggagctccccttgtgggggggccccctccattacccgacctaccgcccttttcctcaccccccaccccactccccaccccctggctgtgactgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaa

SEQ ID NO: 150254 - DNA, 859 bp, Homo sapiens
  Payload ID: 9666
  Gene Symbol: KMT2D
  Gene Name: lysine (K)-specific methyltransferase 2D
  ENST ID: ENST00000526209
  CDS Start-End: 1-657
actggctgtgcccgatcagagcctaaaatcctcacacactacaaacgcgttttcacatccattatctcatttgatcctcacaacaaccttatgaggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcagaatcgaggcatctacatgttccgaataaacaatgaacatgtgattgatgctacgttgaccggcggccctgccaggtacattaaccattcctgtgcccctaactgtgtggccgaagtcgtgacatttgacaaagaggacaaaatcatcatcatctccagccggcgaatccccaaaggagaggagctaacctatgactatcagtttgattttgaggacgatcagcacaagatcccctgccactgtggagcctggaattgtcggaaatggatgaactaagaagctttgaggctaccaggcaggggagtccccctacccacaacctcttccctgaaagggatgagggggaagagaggtagcagccagagccaggacccagggttggggctgccggctgacccggagcccctggagcaggaggctggggcagagggccctaggccaagcccaccctgggcaccagggacaatcctcttcccca

SEQ ID NO: 150255 - DNA, 636 bp, Homo sapiens
  Payload ID: 9666
  Gene Symbol: KMT2D
  Gene Name: lysine (K)-specific methyltransferase 2D
  ENST ID: ENST00000547610
  CDS Start-End: 200-636
ggggggagggtggccactccgacctggatttaccgttcttggcccccctaagcccccccgtgcggggggcggctgtgatcgctctggcggttggaggtcggggagcggcccgggctctggccatgttctcggatgaggatttctggatcgccctgtgaagaggtctccccgagagggccctgcccagtcggagagagggatggacagccagaagctggctggtgaggataaagattcagaaccggcagctgatggacctgcagcttctgaggacccaagtgccactgagtcagacctgcccaacccacatgtgggagaggtctctgtccttagttctgggagtcccaggcttcaggagactcctcaggactgcagtgggggtccggtgcggcgttgtgctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtc

SEQ ID NO: 150256 - DNA, 6714 bp, Homo sapiens
  Payload ID: 9667
  Gene Symbol: KMT2E
  Gene Name: lysine (K)-specific methyltransferase 2E
  Uniprot ID: Q8IZD2
  ENST ID: ENST00000257745
  CDS Start-End: 387-5963
cgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagtttt

SEQ ID NO: 150257 - DNA, 6874 bp, Homo sapiens
  Payload ID: 9667
  Gene Symbol: KMT2E
  Gene Name: lysine (K)-specific methyltransferase 2E
  Uniprot ID: Q8IZD2
  ENST ID: ENST00000311117
  CDS Start-End: 546-6122
gccgccgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagtttta

SEQ ID NO: 150258 - DNA, 5337 bp, Homo sapiens
  Payload ID: 9667
  Gene Symbol: KMT2E
  Gene Name: lysine (K)-specific methyltransferase 2E
  ENST ID: ENST00000334914
  CDS Start-End: 1-5337
atgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaagacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacctactccttccccgtatgctacaccaactcacaccgatattactcctatggacccatcttttgccacgcctccacggataaaatcagatgatgaaacttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaa

SEQ ID NO: 150259 - DNA, 6840 bp, Homo sapiens
  Payload ID: 9667
  Gene Symbol: KMT2E
  Gene Name: lysine (K)-specific methyltransferase 2E
  Uniprot ID: Q8IZD2
  ENST ID: ENST00000334884
  CDS Start-End: 535-3132
cgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatgaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttacccccacccccaccccctcctggtcctgcccctcatcaccatccaccaccccatccatccacaggactccaaggtctacaagcacaacaccagcatgttgtaaattcagcacccccaccaccccctccgccgccaccttccagtgttttggcttctgggcatcataccacatcagctcaagccttacaccacccacctcatcaaggacctccactttttccttcgagtgctcatccaactgtaccaccgtatccctcacaagctacacatcataccactttgggaccgggaccccagcaccagccttctggaacagggccacattgtccattacctgtcacaggtcctcatctccagccccaaggaccaaacagtattccaacacctactgcttcagggttctgtcctcatcctggctctgtggccctgccacatggggttcaaggacctcagcaggcatctccagtgcctggacagattccaattcacagagcacaggtgccaccaacatttcaaaacaattaccatgggtcagggtggcattaaaatggactccaaaaacatttttttaaatgttctgtaagataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatctgtgtgtttctacagaagttctagttttcaaatatagattgtaaggagccttcaattttctttagcgactactacctcagcaacaggaggcagcaaggggctgttcctgtggtggtttctgtttgcatttttgcaggagccataggaaactactgaaatgattgtgctgggtaaattaaggatctggcatcatacaaaatgaagccagaccactaatgcattacagtagttcttgaataca

SEQ ID NO: 150260 - DNA, 375 bp, Homo sapiens
  Payload ID: 9667
  Gene Symbol: KMT2E
  Gene Name: lysine (K)-specific methyltransferase 2E
  ENST ID: ENST00000473063
  CDS Start-End: 1-375
tggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgaccctgatcctgaaaatccagaacccacaactacgaatgaatgtccatccccagatacttctcaaaatacttgtaaaagtcctccaaaaatgagcaa

SEQ ID NO: 150261 - DNA, 1759 bp, Homo sapiens
  Payload ID: 9667
  Gene Symbol: KMT2E
  Gene Name: lysine (K)-specific methyltransferase 2E
  ENST ID: ENST00000482560
  CDS Start-End: 189-623
gtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcactctggagtctccttgaaccagaaccacagtctcccctcccccaaccctggttcagccaccaagaaaggcctcctcccctagagaagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaa

SEQ ID NO: 150262 - DNA, 2523 bp, Homo sapiens
  Payload ID: 9667
  Gene Symbol: KMT2E
  Gene Name: lysine (K)-specific methyltransferase 2E
  Uniprot ID: Q8IZD2
  ENST ID: ENST00000476671
  CDS Start-End: 507-2336
gtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatggtaagttgggaagccagtagtttgggcttagtgacagctgctctgcatatggtaattgttgctgcctttacatgggcttttacattattctttgaagttagcgaatgatgtgccattgagcatttttatttggtttggtcattgccatttaaataaattccattaatcttgtatttttattggttgttcattagagatttaagaatgtatgacatttaagaaatatgaacattttggaagtaataatattttaataatgccacactgaactattaataaattttaatgccacaat

SEQ ID NO: 150263 - DNA, 597 bp, Homo sapiens
  Payload ID: 9667
  Gene Symbol: KMT2E
  Gene Name: lysine (K)-specific methyltransferase 2E
  ENST ID: ENST00000478079
  CDS Start-End: 1-65
cccagaatccaccacaaaagaaaaagagtccagttggcaactttgtgggaagcaatgtagtatagtggaaagagcacgggctttcaagtaagacctaggttcgaatcccggctccaacactcaccagctgtgtgaccttgagtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccag

SEQ ID NO: 150264 - DNA, 1500 bp, Homo sapiens
  Payload ID: 9667
  Gene Symbol: KMT2E
  Gene Name: lysine (K)-specific methyltransferase 2E
  ENST ID: ENST00000478990
  CDS Start-End: 445-1500
gagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagagaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaa

SEQ ID NO: 150265 - DNA, 617 bp, Homo sapiens
  Payload ID: 9667
  Gene Symbol: KMT2E
  Gene Name: lysine (K)-specific methyltransferase 2E
  ENST ID: ENST00000474203
  CDS Start-End: 405-617
cgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgacggagtctcgctctgtcaccaggctggagtgcagtggcgcgatcgcagctcactgcagcctctgactccctagttcaagcgattctcctgcctcagcgtcctgagtagctgggattacaggcacatgccaccaagcccagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcct

SEQ ID NO: 150266 - DNA, 1133 bp, Homo sapiens
  Payload ID: 9667
  Gene Symbol: KMT2E
  Gene Name: lysine (K)-specific methyltransferase 2E
  ENST ID: ENST00000495267
  CDS Start-End: 443-1133
gcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaa

SEQ ID NO: 150267 - DNA, 883 bp, Homo sapiens
  Payload ID: 9667
  Gene Symbol: KMT2E
  Gene Name: lysine (K)-specific methyltransferase 2E
  ENST ID: ENST00000479838
  CDS Start-End: 1-434
gacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaaggtatgattctaatgaatgtaagaactgtttttctaacagtttcttatattaattatattgttgttttaaaaattggatttttaagacctcataataataagaggcagtttttatacttgcagattttaaaactaagaatgagaattccaaaactgtaaaattaatataaatgtttgcattactgtgaagataaagttacattcagtttatcaggacttttatggtattgcaattcatgatttctttaaataagtttgtctactttatgtacaaaatatatacttctctgaaactggttttagatgtgttatcctttatatttttataaatttcattgtataggtagattataagaattaaatgtgaagaaattgatttccacagaatgtactatgaaaatttgtaagaaagagtagttttaggtgtaattattaataaaaatctctgaaacacta

SEQ ID NO: 150268 - DNA, 1588 bp, Homo sapiens
  Payload ID: 9667
  Gene Symbol: KMT2E
  Gene Name: lysine (K)-specific methyltransferase 2E
  ENST ID: ENST00000622386
  CDS Start-End: 12-1373
ggaccataattatggtgctcgtcctctccgacacctccgcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaa

SEQ ID NO: 150269 - DNA, 1753 bp, Homo sapiens
  Payload ID: 9668
  Gene Symbol: KRCC1
  Gene Name: lysine-rich coiled-coil 1
  Uniprot ID: Q9NPI7
  ENST ID: ENST00000347055
  CDS Start-End: 395-1174
tgttcctgcctctccgccacctccaccgcggcttatcccctggctggcggcgttggcggggcgggggacagtagttgtagacgcccgcccctgcctcagagaagataccacattgaatgaacaaagactgaactttgtttacagataccttttataaaagatgtctgtggagtagtgttacagttcaaataacaaaggattttgcattatgagatgagtgagagtggagaattggacaaaaattgatttttgatctctgaattgtggtttttagctcaccagttattgtgtagtctcactatttgaaaattcatgctgaaaaactgagtgaatatgatcagatttctccaccaaattctcagcctgataaggaaaatcccgttttgtcaacctaatgaagcattcaaagaagacatatgactcttttcaagatgaacttgaagattatattaaagtacagaaagccagaggcttagagccaaagacttgtttcagaaagatgaaaggggactatttggaaacctgtgggtacaaaggagaggttaattccagacccacgtatagaatgtttgaccagagactcccatctgaaaccatccagacctacccaagatcatgcaatattccacaaacagtggaaaatcggttgcctcagtggttaccagcccatgacagcagattgagactagactctctgagctactgtcagttcacgagggactgtttctcagaaaaaccagtacccctgaactttaatcaacaagaatatatttgtggctcacatggtgtagaacatagagtttacaagcacttctcctcagataacagtaccagtactcatcaagccagtcacaaacagatacatcagaagaggaaaaggcacccagaggaaggcagagaaaaatcagaggaggagcggtctaagcataagagaaaaaaaagctgcgaggaaattgacttagacaaacacaagagcatccaaagaaagaaaacagaggtggaaatagaaaccgtacatgtcagtacagaaaagcttaagaatcgaaaggagaaaaaaagccgagatgtagtctctaagaaagaggaacgtaagcgtacaaaaaagaaaaaggaacaaggccaagaaaggacagaggaggaaatgctttgggaccagtctattcttggattttgaagctttcaaagttggttctcccaaagttaaattgaaaaaataggtgagagcttggttttatgatatccgtgttcataccacttttcttatgtgaataggttctttaacttctaacaaaggcctagtaaacaaagtgtttagcatgcttgctctccaacacagaaattgcttttcctcattttctaaaagcattattacattttttgaacatatagtgtaatttcctttaatgaaagtgactctgcttttattcatcaaattgctttgatggtggaaatattttctgttgggaggttatttattttaaattggaggattaatgacctttgcacaatctgtttcttgattgggtttgttatagttttgagttgggtattttatgttcattggtttttctctgtgaagcaatttttttctcctttattagatctaacttgcagtgtattttctaggctggaaagtggaaaatgaaatatattataatcttaggttacataaagtttctaaagtttcaaagagtcttgatacaaaatcagtttatattctgaaaatatttataataaagtattctaatttcta

SEQ ID NO: 150270 - DNA, 6432 bp, Homo sapiens
  Payload ID: 9669
  Gene Symbol: KNOP1
  Gene Name: lysine-rich nucleolar protein 1
  Uniprot ID: Q1ED39
  ENST ID: ENST00000219837
  CDS Start-End: 80-1456
ggccggcgactcgaagtggacttccgggtcacggcggagctggctctcacgtggaggcggggaaatttcgcccaccggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaaactccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatgccaggaggagatgaacgtgtggagatgacacgggaagttgcctcatcggctgtggggacagcgtttccaagcctggactctacagcaagcctcaaagagctccaggtccagtggcccaagtcgcatgtgaccatctgtgaccaccttctttccactcacctagctttttgcatcccaaaatacaggttctgactgggacattttcacgatcgtttggcctgaacatgcctcctacagacatcccagcccaggcaggcctcgatggccagaaagttcagtctcacgtggcaggaaggcctgattagggcctggttcaacagctcgccaaggaagcattctctccatcatctccagtgttggcttcatcaaggctagtacaaagatggcagtaacagttccaggcagcatatcaagaccctagaacattccagaggaagaaaagcctttttgtgtctcaaggaaacttccagaagcctccattgctgggcaatgagtcatctgcccatagctgcacccgcccctgtcatgggaaggctggtgattcccttcagtcaagaagagtggatgctggtgaagtggccatggtgtccacagctgcccattgggcagaggtgaggcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtaagtctcatgtggaagttgccatggttttgtttttctttctttttttttttttgagacagtctcactctcactccacgcccaggctggagtgcagaggcgtgatctcagctcactgcaacctccacctccagggttcaagcgattctcctgcctcagcctcctgagaagctgggattacaggtgagcaccaccacacccagctaatttttttttgtatttttagtagagatggagtttcaccatgttggccaggatggtcttgatctcttggcctcatgatccacctacctcagcctcccaaagtgttggtattacaggcatgagccaccgcacccaggccccatcatttttattttctacaattctggctgacatcttattgctccatccttgctaatgatagacttcatctcacatagaccagtgttttcagagaccggcttattgattcagtaaagggctgggggaaactgcacacacaaggacatataaaatctaagcctctgcctgggccacatgacaggattcagaagcacctttgatataatgggtgcccgacctcatgtgaaagtccaagttcaggtgtaatgtgagagcggtaagaattcactggcctaggcttgggaactaatgctgcccaccacgttcagcctcagaggagaagaaatgacttgaagaacataatttgtgaatttgccaattgtttttcattttatagcatcacacagtaaaagtagataaaataattttaatgaaaatacttctgtgggccaggtgcggtggcttacgcctgtaatcccagcactttgggaggccgaggcggcggatcacctgaggtcaggagttctagaccagcctgaccaacatggagaaaccccatctctactaaaaatacaaaattagctgggtgtggtggcgcactcctgttatcccagctactcaggaggctgaggcaggagaattgcttagactcgggaggcggaggttggggtgagccgagatcacgccattgtactccagcctgggcaacaagagtgaaactgtctcaaaaaaaagaaaaaaaaacagaattttgtgaaataaaggccacttgggagtatctgagccaccccacaa

SEQ ID NO: 150271 - DNA, 1020 bp, Homo sapiens
  Payload ID: 9669
  Gene Symbol: KNOP1
  Gene Name: lysine-rich nucleolar protein 1
  ENST ID: ENST00000564480
  CDS Start-End: 784-1020
ggccggcgcggggtgtggagattgcaccagaggaagtgcgcggcggggaagatggggaaatgcggtccacccacatccctgaatccgacccctccagtcggtgtgcgcccgctccggcctgaggccgccgcctccagaaagttttcccgcctcagagccggccctgggaccccacgtaatccctcccagtctgttgatgcggaggcttgggcccatgggagccttggaggtacggatcttacttcctggctcccgcgcgtcctgctggtgatcctgccgggggagtggggtgttgctgcacaggctttggagtcctgtgggcggaattccagtctccgttttccacttgctggctttggaacctagggcaagtgaattattgtagtctctggagcttgcgaggtcgggtattcacaaagatcttcacaaggctgtccctggaatttaaaagcggttttggagaaagcgtttgcgtttgcaggagatgcactgtaacgttcttttcctttctccttgaaagagtgaatgcatttggtcgcagggctaaagaggaggatgctatacttttctaaatggcaagagatggggagagaaggggattaagagttgacccgcaacctcccggtggattctttgttcttaccagatctcttggccactcccctattctgaagtcgtcttggctctcttgactgctcccctattctgaagtcgtcttggctctcttgactgctcccctattctgaagtcgtcttggctctcctgactacactatttcaaggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgag

SEQ ID NO: 150272 - DNA, 1311 bp, Homo sapiens
  Payload ID: 9669
  Gene Symbol: KNOP1
  Gene Name: lysine-rich nucleolar protein 1
  ENST ID: ENST00000568230
  CDS Start-End: 344-757
cacagcagcccacccagtccagcaaatgcacatgtgttgcaggcctggatgagtgatgggaatggagagggcttccagggtcatcacacacgtgacgctaggtgccaggcacagcacacttctcaagtgaggacgcatgaaatgtcagcatttgtcgttactgaagaaccccaagaaagtggccggcctgaggtctcgctgttggagggtgtcttcagggccaaggcgggtgggagagcatggtgcatgttagtgtggtccttggcctctgtcctgtagtttggtgtcaccgtaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagcca

SEQ ID NO: 150273 - DNA, 595 bp, Homo sapiens
  Payload ID: 9669
  Gene Symbol: KNOP1
  Gene Name: lysine-rich nucleolar protein 1
  ENST ID: ENST00000567367
  CDS Start-End: 1-595
ggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactg

SEQ ID NO: 150274 - DNA, 2479 bp, Homo sapiens
  Payload ID: 9670
  Gene Symbol: LYSMD1
  Gene Name: LysM, putative peptidoglycan-binding, domain containing 1
  Uniprot ID: Q96S90
  ENST ID: ENST00000368908
  CDS Start-End: 662-1345
cttttgggaaatgaagtcttttctcaaagaccttgccgctcaactggatccaggcccttgcatcttggcggatctgaggcgtttggagggacaacaacctagatgtggagccgaaatttgagggtgtgacctatcttatgcggagcggacctttgaggatctctgagtggaaggtgtactacaaattcttgcaatcctcacgctcttcgtctgcggcgacagttcacctggggtgggcctgatttgttcctgactctagcaaacaaaccccgggaccggggagagctgggatgttggagcgccctgaggccaggctacttgggggcaaactgaggaaagagtgttgaggattatttctagagttcaaaggtcagaggtcaatgtagcgaggagttgtgggggagtccaaagtcggaggggtgcttaggggagaattagggagggactgaatactcaagggacagatttgtggataagtagcttggagggaggagaaaccgggagggggcagatggcgtagtgctggggaggcggggacacaggggaagagagagggggaaaggaatcccctgaatattcattcccagacttcaggcctgtcagtcgcagtctcggtcgtacctcccctagttgcaaccttagctgttggcagggtgaagagatggcttccccgtctagacagcccccgccaggggggtcaggactgcttcaagggagccgggctcgttcatatggaagcctggtgcaatcggcctgctccccagtgagggaaagacgcctggagcatcagttggagcccggagacaccctggctggactagcactcaaatatggggtgacgatggaacagattaaacgtgcaaaccgcctttatactaatgactccatcttcctgaagaaaaccctctacatccccatcctgacagagcccagagacctgttcaatggtttggactctgaggaagagaaagatggagaggaaaaagtacacccaagtaacagtgaagtttggccacactcaactgagaggaagaaacaagagacaggagcaggacgtgccaatggtgaagtcctccccacacctggccaggaaacccccacgcccatccatgacctctctgcctctgatttccttaagaagcttgattcacagatcagcctgtccaagaaggctgctgctcagaagctgaaaaaaggggaaaatggggtacctggggaggatgcaggtctccacctgagctccccttggatgcagcaacgagcagtcctaggtcctgtgccgctgacccgtacctctcggacccggacactacgggaccaggaggatgaaatcttcaaactctgatgtccccagaactgactgagagaagcaagatgttgaaagagaaacttcagggggagaggagcctgaggtgaggctcaagaacatggcttatgagcctgcctccctccactccagccatcctccccagcctccttgtctgccaaaaattccttggcctggggcagttttattggcaagattagggaatgggaactggacctttcccagttcttgggctgaatctagagttgagtcctttagactcaaaaggctctttttatatccttgttgcctttcctatcctttttacctttccctggccttagaacagggaagcagagactccccctcagcttcttcctcatctccaactatgtgacataatttatttggtgctaatattgaagtaatatttatttgctatattttatttcttcccactcttagctgaaaaatggaatttctatagccctggggtgaggagaacccgggaacagtgagccagtgactgctggttctccactttccccaccttgttagccaaacatgttattgaggatgaggcaatcggtgatatagcccaccacagagaatggatgactgttggccttttctccaatctcaaagtgacagatttgggctgattctttttttttttttttttggtaccccattcctgttgaatgggctcagtcttgacaaaccaattccctgtaactttttcacaattcttgactctgagaaaaagcagcactgtagggacctgaactctccattctaccagttcacccttctgacctgttctgctcagcctgtggtgaggggaacagatggaagaaggctttccttggggtttgaagaggaagccagttgtgggagtctctttgttacaccccctcccctccagaccctctctctctatgccttcctcctcactgcatatttatttgcgatttgtagcactgatctatggtacagttgttttgtttcttaaacagaagtaggtaagggaacctcagtaataatggaaatctgcctcagtctcctgtttggaaatgatgagaggtgagataagtaatgtttatatacctcctttcttctgtgatgattataaggtatacgaagctggacagattaaacattgagccctgtgca

SEQ ID NO: 150275 - DNA, 1003 bp, Homo sapiens
  Payload ID: 9670
  Gene Symbol: LYSMD1
  Gene Name: LysM, putative peptidoglycan-binding, domain containing 1
  Uniprot ID: Q96S90
  ENST ID: ENST00000440902
  CDS Start-End: 167-706
ggtgccctgcgactccgcagacgcggagccttttgggaaatgaagtcttttctcaaagaccttgccgctcaactggatccaggcccttgcatcttggcggatctgaggcgtttggagggacaacaacctagatgtggagccgaaatttgagggtgtgacctatcttatgcggagcggacctttgaggatctctgagtggaagatggaacagattaaacgtgcaaaccgcctttatactaatgactccatcttcctgaagaaaaccctctacatccccatcctgacagagcccagagacctgttcaatggtttggactctgaggaagagaaagatggagaggaaaaagtacacccaagtaacagtgaagtttggccacactcaactgagaggaagaaacaagagacaggagcaggacgtgccaatggtgaagtcctccccacacctggccaggaaacccccacgcccatccatgacctctctgcctctgatttccttaagaagcttgattcacagatcagcctgtccaagaaggctgctgctcagaagctgaaaaaaggggaaaatggggtacctggggaggatgcaggtctccacctgagctccccttggatgcagcaacgagcagtcctaggtcctgtgccgctgacccgtacctctcggacccggacactacgggaccaggaggatgaaatcttcaaactctgatgtccccagaactgactgagagaagcaagatgttgaaagagaaacttcagggggagaggagcctgaggtgaggctcaagaacatggcttatgagcctgcctccctccactccagccatcctccccagcctccttgtctgccaaaaattccttggcctggggcagttttattggcaagattagggaatgggaactggacctttcccagttcttgggctgaatctagagttgagtcctttagactcaaaaggctctttttatatccttgttgcctttcctatcctttttacctttccct

SEQ ID NO: 150276 - DNA, 1759 bp, Homo sapiens
  Payload ID: 9671
  Gene Symbol: LYSMD2
  Gene Name: LysM, putative peptidoglycan-binding, domain containing 2
  Uniprot ID: Q8IV50
  ENST ID: ENST00000267838
  CDS Start-End: 516-1163
ggaagtacccttggcattggcagagctggaaggtctgtgcaagctggctcctgctggggaatcaataaaggaggcagagcaacgctttttttttttttcgccgtggccagggcagggttctgccagggctctatcgccaatggagcaggggtccacctggggcctaggacgcctgcagatagccctctcttagccccaacggccgcgggcttcagcgctccccggctccctcgctctgcagggtcttcccggtaccggcaggccgcggcgggagctgctttcgctcttaaccttgcaggtgcgtgtgccgcgggcgcccggggcaggcaggacgcagaggaggaggcgcccgccatgcccggcctgcggctccccgcctcggcttcccgtccgccgcccccgcggaacggcctgctgcagcccctgtgaagaggaagaggcggcggcggcggcggaggaggaggaggcgccgcccccttggcaagctccccgacccggcggcctcggcaggacccatggcggattcctcgcccgcactgtccctgcgggaaggcggcccccgcgcgccgcggccctcggccccctcgccgccgccgcgctcgcgctccggctccgagtccgaggaggccgagctgtcgctgagcctggcccgcaccaagacccgctcgtacggcagcaccgccagcgtgcgggcgccgctgggcgccggcgtcatcgagcgccatgtggagcaccgggtccgcgcgggcgacacgctgcagggcatcgcgctcaagtacggtgtcacgatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaacttgagtctcctttttttttttaacaaatgagaaaataaaattgacttttaaattata

SEQ ID NO: 150277 - DNA, 1228 bp, Homo sapiens
  Payload ID: 9671
  Gene Symbol: LYSMD2
  Gene Name: LysM, putative peptidoglycan-binding, domain containing 2
  Uniprot ID: Q8IV50
  ENST ID: ENST00000454181
  CDS Start-End: 316-690
ggccgggcgcggcgccggggcgcgcggctgcagcggagcaggctgggaagcgtagttcccggctgagcctcgccgcggccccgcagtcccccagccccgcccttccccgacaggtgtcctctcccggaatcggggtctgaaccccgccacagctctgcaggggaggaagcacctgggtcggggagaagcctgggcaggctctttggagacgctcggggctccggagagcgtggatggcaaaggctttcaagcctgtgatgagcattcctgtgagcgagcatcctgacacggaagccgcgttgagagcggtctcagatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggttgctgtttaagtgatgctgaatttgctgtgtgtttataacttaagtgctatatatatatttcgatatgtcttacatattctctattaatataaagaaccaaattttgtctgctattttgtaaaaataaactacaaaagcctgaatgagaaaataaactatgttttcaaa

SEQ ID NO: 150278 - DNA, 775 bp, Homo sapiens
  Payload ID: 9671
  Gene Symbol: LYSMD2
  Gene Name: LysM, putative peptidoglycan-binding, domain containing 2
  ENST ID: ENST00000558126
  CDS Start-End: 86-412
acagctctgcaggggaggaagcacctgggtcggggagaagcctgggcaggctctttggagacgctcggggctccggagagcgtggatggcaaaggctttcaagcctgtgatgagcattcctgtgagcgagcatcctgacacggaagccgcgttgagagcggtctcagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaa

SEQ ID NO: 150279 - DNA, 1026 bp, Homo sapiens
  Payload ID: 9671
  Gene Symbol: LYSMD2
  Gene Name: LysM, putative peptidoglycan-binding, domain containing 2
  Uniprot ID: Q8IV50
  ENST ID: ENST00000560491
  CDS Start-End: 283-657
ttggcagagctggaaggtctgtgcaagctggctcctgctggggaatcaataaaggaggcagagcaacgctttttttttttttcgccgtggccagggcagggttctgccagggctctatcgccaatggagcaggggtccacctggggcctaggacgcctgcagatagccctctcttagccccaacggccgcgggcttcagcgctccccggctccctcgctctgcagggtcttcccggtaccggcaggccgcggcgggagctgctttcgctcttaaccttgcagatggaacagattaaaagggccaataaactgtttaccaatgattgtatatttctgaagaaaactttgaacatcccagttatatcagagaagcctttgttgtttaatggacttaactccattgattctccagaaaatgaaactgctgataacagtttttctcaggaagaggagccagtggtggccggggaagacctccctcctcccagtcctcaagaatctgatgttcagcctgtgcagcctgaggaagtgtcagccagagatttcctgcagagacttgacttgcagattaagttatcaacacaggcagccaagaagctaaaagaagagagcagagatgaagaaagtccctatgcaacttccctctatcacagttaggtgatttgggggcataactctaaccaaaattaagatatgtttggaccataaagaatccaacaactgaagattcaaaaacatcccttctggattcctatagtgtccatcttaaaatcataactaggtagttctacctgctgcagttgcactgaagtgattagttccctctggctttctataattttaagtctttattatggcatgatggcaaggttgtagcctaaagctcatcacttttgtaggtggtgttagtttttagactagcttttataaatactaattgacataaagcatcaaagattatttatatatttaggctaaaaataatgtttatctccttatgcaatcctgattatgtgaaaatatggt
